US011414489B2

(12) United States Patent
Rosengren et al.

(10) Patent No.: US 11,414,489 B2
(45) Date of Patent: Aug. 16, 2022

(54) COMBINATION THERAPY WITH A HYALURONAN-DEGRADING ENZYME AND AN IMMUNE CHECKPOINT INHIBITOR

(71) Applicant: HALOZYME, INC., San Diego, CA (US)

(72) Inventors: Sanna Rosengren, Encinitas, CA (US); H. Michael Shepard, Springfield, OR (US); Curtis B. Thompson, San Diego, CA (US)

(73) Assignee: Halozyme, Inc., San Diego, CA (US)

( * ) Notice: Subject to any disclaimer, the term of this patent is extended or adjusted under 35 U.S.C. 154(b) by 0 days.

(21) Appl. No.: 15/444,151

(22) Filed: Feb. 27, 2017

(65) Prior Publication Data

US 2017/0218069 A1 Aug. 3, 2017
US 2018/0044419 A9 Feb. 15, 2018

Related U.S. Application Data

(63) Continuation of application No. PCT/US2015/047588, filed on Aug. 28, 2015.

(60) Provisional application No. 62/043,351, filed on Aug. 28, 2014.

(51) Int. Cl.
| | |
|---|---|
| *C07K 16/28* | (2006.01) |
| *A61K 38/47* | (2006.01) |
| *A61K 39/395* | (2006.01) |
| *C12N 9/26* | (2006.01) |
| *A61K 9/00* | (2006.01) |
| *A61K 31/573* | (2006.01) |
| *A61P 35/00* | (2006.01) |
| *C12N 15/00* | (2006.01) |
| *A61K 47/60* | (2017.01) |
| *A61K 39/00* | (2006.01) |
| *A61K 9/127* | (2006.01) |

(52) U.S. Cl.
CPC ........ *C07K 16/2827* (2013.01); *A61K 31/573* (2013.01); *A61K 38/47* (2013.01); *A61K 39/39558* (2013.01); *A61K 47/60* (2017.08); *A61P 35/00* (2018.01); *C07K 16/2803* (2013.01); *C07K 16/2818* (2013.01); *C12N 9/2474* (2013.01); *C12N 15/00* (2013.01); *C12Y 302/01035* (2013.01); *A61K 9/0019* (2013.01); *A61K 9/127* (2013.01); *A61K 39/3955* (2013.01); *A61K 2039/54* (2013.01); *A61K 2039/545* (2013.01); *C07K 2317/76* (2013.01)

(58) Field of Classification Search
CPC ...... A61K 38/47; A61K 39/395–39558; A61K 2039/545; C07K 16/00–468; C12Y 302/01035
See application file for complete search history.

(56) References Cited

U.S. PATENT DOCUMENTS

| | | | |
|---|---|---|---|
| 2,488,564 A | 11/1949 | Singher et al. | 435/201 |
| 2,488,565 A | 11/1949 | Singher et al. | 435/201 |
| 2,676,139 A | 4/1954 | Tint et al. | 424/201 |
| 2,795,529 A | 6/1957 | Alburn et al. | 424/94.3 |
| 2,806,815 A | 9/1957 | Singher et al. | 435/188 |
| 2,808,362 A | 9/1957 | Thompson et al. | 435/201 |
| 3,536,809 A | 10/1970 | Applezweig | 424/28 |
| 3,539,794 A | 11/1970 | Rauhut et al. | 240/2.25 |
| 3,598,123 A | 8/1971 | Zaffaroni | 424/435 |
| 3,630,200 A | 12/1971 | Higuchi | 424/427 |
| 3,710,795 A | 1/1973 | Higuchi et al. | 424/424 |
| 3,845,770 A | 11/1974 | Theeuwes et al. | 424/427 |
| 3,847,770 A | 11/1974 | Radlowe et al. | 204/159.23 |
| 3,916,899 A | 11/1975 | Theeuwes et al. | 424/424 |
| 4,002,531 A | 1/1977 | Royer | 435/188 |
| 4,008,719 A | 2/1977 | Theeuwes et al. | 424/427 |
| 4,078,052 A | 3/1978 | Papahadjopoulos | 424/36 |
| 4,179,337 A | 12/1979 | Davis et al. | 435/181 |
| 4,224,179 A | 9/1980 | Schneider | 252/316 |
| 4,235,871 A | 11/1980 | Papahadjopoulos et al. | 424/19 |
| 4,308,166 A | 12/1981 | Marchetti | 252/316 |
| 4,310,506 A | 1/1982 | Baldeschwieler et al. | 424/1 |
| 4,394,372 A | 7/1983 | Taylor | 424/85 |
| 4,485,054 A | 11/1984 | Mezei | 264/4.6 |
| 4,508,703 A | 4/1985 | Redziniak et al. | 424/38 |
| 4,522,803 A | 6/1985 | Lenk et al. | 424/1.1 |
| 4,687,660 A | 8/1987 | Baker et al. | 424/465 |
| 4,769,027 A | 9/1988 | Baker et al. | 424/493 |
| 4,816,567 A | 3/1989 | Cabilly et al. | 435/172.3 |
| 4,946,778 A | 8/1990 | Ladner et al. | 435/240.2 |
| 4,952,496 A | 8/1990 | Studier et al. | 435/91.41 |
| 5,033,252 A | 7/1991 | Carter | 53/425 |

(Continued)

FOREIGN PATENT DOCUMENTS

| | | |
|---|---|---|
| EP | 0400472 | 12/1990 |
| EP | 1262193 | 12/2002 |

(Continued)

OTHER PUBLICATIONS

Almagro & Fransson, Frontiers in Bioscience 13:1619-33 (Year: 2008).*

(Continued)

*Primary Examiner* — Jessica H Roark

(74) *Attorney, Agent, or Firm* — Dentons US LLP; Stephanie Seidman

(57) ABSTRACT

Provided are methods of treatments with combinations or compositions containing a soluble hyaluronidase, such as a polymer-modified hyaluronidase, and an immune checkpoint inhibitor treating cancers, including solid and non-solid tumors. The combinations and compositions also are provided.

22 Claims, No Drawings

Specification includes a Sequence Listing.

(56) References Cited

U.S. PATENT DOCUMENTS

| | | | |
|---|---|---|---|
| 5,041,292 A | 8/1991 | Feijen | 424/484 |
| 5,052,558 A | 10/1991 | Carter | 206/439 |
| 5,059,595 A | 10/1991 | Le Grazie | 424/468 |
| 5,073,543 A | 12/1991 | Marshall et al. | 514/21 |
| 5,120,548 A | 6/1992 | McClelland et al. | 424/473 |
| 5,122,614 A | 6/1992 | Zalipsky | 548/520 |
| 5,171,081 A | 12/1992 | Pita et al. | 362/101 |
| 5,258,498 A | 11/1993 | Huston et al. | 424/85.8 |
| 5,323,907 A | 6/1994 | Kalvelage | 206/531 |
| 5,324,844 A | 6/1994 | Zalipsky | 548/520 |
| 5,354,556 A | 10/1994 | Sparks | 424/419 |
| 5,446,090 A | 8/1995 | Harris | 525/54.1 |
| 5,571,894 A | 11/1996 | Wels et al. | 530/387.3 |
| 5,587,458 A | 12/1996 | King et al. | 530/387.3 |
| 5,591,767 A | 1/1997 | Mohr et al. | 514/413 |
| 5,612,460 A | 3/1997 | Zalipsky | 530/391.9 |
| 5,631,018 A | 5/1997 | Zalipsky et al. | 424/450 |
| 5,639,476 A | 6/1997 | Oshlack et al. | 424/468 |
| 5,641,870 A | 6/1997 | Rinderknecht et al. | 530/417 |
| 5,643,575 A | 7/1997 | Martinez et al. | 424/194.1 |
| 5,658,727 A | 8/1997 | Barbas et al. | 435/172.1 |
| 5,667,988 A | 9/1997 | Barbas et al. | 435/69.1 |
| 5,672,662 A | 9/1997 | Harris et al. | 525/408 |
| 5,674,533 A | 10/1997 | Santus et al. | 424/493 |
| 5,714,166 A | 2/1998 | Tomalia et al. | 424/486 |
| 5,723,147 A | 3/1998 | Kim et al. | 424/450 |
| 5,733,566 A | 3/1998 | Lewis | 424/426 |
| 5,747,027 A | 5/1998 | Stern et al. | 424/94.62 |
| 5,766,581 A | 6/1998 | Bartley et al. | 424/85.1 |
| 5,766,627 A | 6/1998 | Sankaram et al. | 424/450 |
| 5,795,569 A | 8/1998 | Bartley et al. | 424/85.1 |
| 5,808,096 A | 9/1998 | Zalipsky | 548/520 |
| 5,827,721 A | 10/1998 | Stern et al. | 435/201 |
| 5,840,300 A | 11/1998 | Williams et al. | 424/135.1 |
| 5,900,461 A | 5/1999 | Harris | 525/54.11 |
| 5,919,455 A | 7/1999 | Greennnwald et al. | 424/178.1 |
| 5,932,462 A | 8/1999 | Harris et al. | 435/188 |
| 5,962,016 A | 10/1999 | Willis | 424/450 |
| 5,985,263 A | 11/1999 | Lee et al. | 424/85.2 |
| 5,990,237 A | 11/1999 | Bentley et al. | 525/54.2 |
| 6,054,569 A | 4/2000 | Benett et al. | 424/945 |
| 6,106,858 A | 8/2000 | Ye et al. | 264/4.1 |
| 6,113,906 A | 9/2000 | Greenwald et al. | 424/194.1 |
| 6,214,966 B1 | 4/2001 | Harris | 528/322 |
| 6,241,999 B1 | 6/2001 | Ye et al. | 264/4.1 |
| 6,258,351 B1 | 7/2001 | Harris | 424/78.3 |
| 6,306,432 B1 | 10/2001 | Shirley et al. | 264/4.1 |
| 6,340,742 B1 | 1/2002 | Burg et al. | 530/351 |
| 6,413,507 B1 | 7/2002 | Bentley et al. | 424/78 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,495,659 B2 | 12/2002 | Bentley et al. | 528/425 |
| 6,682,736 B1 | 1/2004 | Hanson et al. | 424/144.1 |
| 6,737,505 B2 | 5/2004 | Bentley et al. | 528/425 |
| 6,828,401 B2 | 12/2004 | Nho et al. | 526/333 |
| 6,858,736 B2 | 2/2005 | Nho et al. | 546/290 |
| 6,984,720 B1 | 1/2006 | Korman et al. | 530/388.22 |
| 7,105,330 B2 | 9/2006 | Stern et al. | 435/200 |
| 7,219,016 B2 | 5/2007 | Rimm et al. | 702/19 |
| 7,229,619 B1 | 6/2007 | Young et al. | 424/159.1 |
| 7,257,268 B2 | 8/2007 | Eichhorn et al. | 382/253 |
| 7,646,905 B2 | 1/2010 | Guittet et al. | 382/133 |
| 7,767,429 B2 | 8/2010 | Bookbinder et al. | 435/201 |
| 7,943,743 B2 | 5/2011 | Korman et al. | 530/388.15 |
| 8,008,449 B2 | 8/2011 | Korman et al. | 530/388.15 |
| 8,023,714 B2 | 9/2011 | Soenksen | 382/132 |
| 8,202,517 B2 | 6/2012 | Bookbinder et al. | 424/94.62 |
| 8,217,149 B2 | 7/2012 | Irving et al. | 530/387.1 |
| 8,431,380 B2 | 4/2013 | Bookbinder et al. | 435/201 |
| 8,450,470 B2 | 5/2013 | Bookbinder et al. | 536/23.2 |
| 8,679,767 B2 | 3/2014 | Kaur et al. | 435/7.1 |
| 8,735,553 B1 | 5/2014 | Li et al. | 530/388.22 |
| 8,779,105 B2 | 7/2014 | Korman et al. | 530/388.1 |
| 8,779,108 B2 | 7/2014 | Queva et al. | 530/388.73 |
| 9,913,822 B2 | 3/2018 | Maneval et al. | 435/195 |
| 10,328,130 B2 * | 6/2019 | Frost | A61K 31/337 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0086014 A1 | 7/2002 | Korman et al. | 424/144.1 |
| 2002/0156047 A1 | 10/2002 | Zhao | 514/58 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0220447 A1 | 11/2003 | Harris | 528/322 |
| 2004/0013637 A1 | 1/2004 | Bentley et al. | 424/78.17 |
| 2004/0235734 A1 | 11/2004 | Bossard | 514/12 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0180969 A1 | 8/2005 | Hardy et al. | 424/141.1 |
| 2005/0209416 A1 | 9/2005 | Harris | 525/523 |
| 2005/0260186 A1 | 11/2005 | Bookbinder et al. | 424/94.62 |
| 2006/0104968 A1 | 5/2006 | Bookbinder et al. | 424/94.62 |
| 2007/0166281 A1 | 7/2007 | Kosak | 424/85.1 |
| 2007/0235889 A1 | 10/2007 | Hartounian et al. | 264/4.1 |
| 2008/0248028 A1 | 10/2008 | Lazar et al. | 424/133.1 |
| 2009/0074787 A1 | 3/2009 | Gomez-Navarro et al. | 424/142.1 |
| 2010/0003238 A1 | 1/2010 | Frost et al. | 424/94.62 |
| 2010/0136549 A1 | 6/2010 | Christiansen et al. | 702/19 |
| 2010/0143457 A1 | 6/2010 | Wei et al. | 424/450 |
| 2010/0305500 A1 | 12/2010 | Lambert et al. | 604/82 |
| 2011/0111435 A1 | 5/2011 | Dobson et al. | 435/6 |
| 2011/0152359 A1 | 6/2011 | Bookbinder et al. | 435/200 |
| 2012/0020951 A1 | 1/2012 | Shepard et al. | 424/130.1 |
| 2012/0148535 A1 | 6/2012 | Carrió et al. | 424/93.2 |
| 2013/0034559 A1 | 2/2013 | Queva et al. | 424/139.1 |
| 2013/0045202 A1 | 2/2013 | Irving et al. | 424/133.1 |
| 2013/0202583 A1 | 8/2013 | Jiang et al. | 424/94.62 |
| 2013/0251786 A1 | 9/2013 | Li et al. | 424/94.62 |
| 2013/0287688 A1 | 10/2013 | Jain et al. | 424/9.1 |
| 2013/0302275 A1 | 11/2013 | Wei et al. | 424/94.62 |

FOREIGN PATENT DOCUMENTS

| | | |
|---|---|---|
| EP | 0822199 | 9/2004 |
| EP | 1064951 | 8/2007 |
| WO | WO 1993/016185 | 8/1993 |
| WO | WO 1994/28024 | 12/1994 |
| WO | WO 2000/002017 | 1/2000 |
| WO | WO 2000/037504 | 6/2000 |
| WO | WO 2001/076640 | 10/2001 |
| WO | WO 2001/087925 | 11/2001 |
| WO | WO 2002/049673 | 6/2002 |
| WO | WO 2002/096368 | 12/2002 |
| WO | WO 2005/000360 | 1/2005 |
| WO | WO 2005/118799 | 12/2005 |
| WO | WO 2008/156712 | 12/2008 |
| WO | WO 2009/111066 | 9/2009 |
| WO | WO 2009/128917 | 10/2009 |
| WO | WO 2010/027827 | 3/2010 |
| WO | WO 2010/077634 | 7/2010 |
| WO | WO 2011/066342 | 6/2011 |
| WO | WO 2012/109387 | 8/2012 |
| WO | WO 2013/019906 | 2/2013 |
| WO | WO-2015095418 A1 * | 6/2015 ......... A61K 31/337 |
| WO | WO 2016/061286 | 4/2016 |

OTHER PUBLICATIONS

Rudikoff et al., Proc. Nat'l Acad. Sci. USA, 79:1979-83 (Year: 1982).*

Brown et al., J. Immunol., 156(9):3285-91 (Year: 1996).*

Rentero et al., Chimia, 65: 843-845 (Year: 2011).*

Letter/Written Disclosure of the Supplemental Information Disclosure Statement for the above-referenced application, filed herewith on Jul. 10, 2018, 2 pages.

(56) References Cited

OTHER PUBLICATIONS

Clift et al., "PEGylated recombinant hyaluronidase PH20 (pegvorhyaluronidase alfa PEGPH20) converts HA-rich tumors from resistant to sensitive to anti-PD-L1 immunotherapy in murine syngeneic breast cancer models," AACR Annual Meeting Apr. 14-18, 2018. Chicago, IL. Abstract #2740, Available on-line Mar. 2018 [Retrieved from the internet on Mar. 23, 2018], 2 pages.
Clift et al., "PEGylated Recombinant Hyaluronidase PH20 (Pegvorhyaluronidase Alfa PEGPH20) Converts HA-rich Tumors from Resistant to Sensitive to Anti-PD-L1 Immunotherapy in Murine Syngeneic Breast Cancer Models," AACR Annual Meeting Apr. 14-18, 2018. Chicago, IL. Poster 2740 [poster and panels], 7 pages.
Clift et al., "Rationale for evaluating PEGylated recombinant human hyaluronidase PH20 (pegvorhyaluronidase alfa; PEGPH20) in patients with hyaluronan (HA)-accumulating colorectal cancer," AACR Annual Meeting Apr. 14-18, 2018. Chicago, IL. Abstract #1743, Available on-line Mar. 2018 [Retrieved from the internet on Mar. 23, 2018], 1 page.
Clift et al., "Rationale for Evaluating PEGylated Recombinant Human Hyaluronidase PH20 (Pegvorhyaluronidase Alfa; PEGPH20) in Patients with Hyaluronan (HA)-Accumulating Colorectal Cancer," AACR Annual Meeting Apr. 14-18, 2018. Chicago, IL. Poster #1743 [poster and panels], 6 pages.
Thompson et al., "Hyaluronan (HA) accumulation restricts CD8 T cell numbers and skews tumor-associated macrophage (TAM) phenotype in mouse syngeneic pancreatic tumors," AACR Annual Meeting Apr. 14-18, 2018. Chicago, IL. Abstract #1747, Available on-line Mar. 2018 [Retrieved from the internet on Mar. 23, 2018], 1 page.
News Release, "Halozyme Initiates Clinical Trial of PEGPH20 with Anti-PDL1 Immunotherapy in Cholangiocarcinoma and Gallbladder Cancer Patients," Published Oct. 16, 2017 [online] Retrieved from:<URL: halozyme.com/investors/news-releases/news-release-details/2017/Halozyme-Initiates-Clinical-Trial-Of-PEGPH20-With-Anti-PDL1-Immimotherapy-In-Cholangiocarcinoma-And-Gallbladder-Cancer-Patients/default.aspx [retrieved on Oct. 16, 2017], 5 pages.
News Release, "Halozyme to Present Nonclinical Data at SITC 2017 Supporting Combination of PEGPH20 with Checkpoint Inhibitors," Published Nov. 10, 2017 [online] Retrieved from:<URL: halozyme.com/investors/news-releases/news-release-details/2017/Halozyme-To-Present-Nonclinical-Data-At-SITC-2017-Supporting-Combination-Of-PEGPH20-With-Checkpoint-Inhibitors/default.aspx [retrieved on Dec. 21, 2017], 3 pages.
Communication pursuant to Article 94(3), dated Feb. 21, 2018, in connection with European Patent Application No. 15760604.7, 4 pages.
Letter/Written Disclosure of the Information Disclosure Statement for the above-referenced application, mailed on Apr. 24, 2017, 2 pages.
"Assays for Cell Proliferation Studies," Genetic Eng. Biotechnol. News. 26(6). Mary Ann Liebert, publisher (2006); Retrieved from URL:// genengnews.com/gen-articles/assays-for-cell-proliferation-studies/1442/ [Retrieved on May 11, 2013], 6 pages.
Adamia et al., "Aberrant posttranscriptional processing of hyaluronan synthase 1 in malignant transformation and tumor progression," Adv. Cancer Res. 123:67-94 (2014).
Adams et al., "The c-myc oncogene driven by immunoglobulin enhancers induces lymphoid malignancy in transgenic mice," Nature 318:533-538 (1985).
Alexander et al., "Expression of the c-myc oncogene under control of an immunoglobulin enhancer in E mu-myc transgenic mice," Mol. Cell Biol. 7:1436-1444 (1987).
Altschul, S., "Basic local alignment search tool," J Molec Biol 215(3):403-410 (1990).
Ansel, Introduction to Pharmaceutical Dosage Forms, Fourth Edition, p. 126 (1985).
Anttila et al., "High levels of stromal hyaluronan predict poor disease outcome in epithelial ovarian cancer," Cancer Res. 60(1):150-155 (2000).

Arming et al., "In vitro mutagenesis of PH-20 hyaluronidase from human sperm," Eur J Biochem. 247(3):810-814 (1997).
Arndt et al., "Helix-stabilized Fv (hsFv) antibody fragments: substituting the constant domains of a Fab fragment for a heterodimeric coiled-coil domain," J Mol Biol. 312(1):221-228 (2001).
Auvinen et al., "Hyaluronan in Peritumoral Stroma and Malignant Cells Associates with Breast Cancer Spreading and Predicts Survival," American Journal of Pathology 156(2):529-536 (2000).
Bacus et al., "Potential use of image analysis for the evaluation of cellular predicting factors for therapeutic response in breast cancers," Anal Quant Cytol Histol. 19(4): 316-328 (1997). Abstract, 2 pages.
Benhar et al., "Pseudomonas exotoxin A mutants. Replacement of surface-exposed residues in domain III with cysteine residues that can be modified with polyethylene glycol in a site-specific manner," J. Biol. Chem. 269:13398-14404 (1994).
Berman et al., "Association of peripheral blood absolute lymphocyte count (ALC) and clinical activity in patients (pts) with advanced melanoma treated with ipilimumab," J Clin Oncol 27:15s (2009) (suppl; abstr 3020).
Bernoist, C. and P. Chambon, "In vivo sequence requirements of the SV40 early promotor region," Nature 290:304-310 (1981).
Bird et al., "Single-chain antigen-binding proteins," Science 242(4877):423-426 (1988).
Bjorck, L., "Protein L. A novel bacterial cell wall protein with affinity for Ig L chains," J. Immunol., 140(4):1194-1197 (1988).
Blundell et al., "The Link Module from Ovulation- and Inflammation-associated Protein TSG-6 Changes Conformation on Hyaluronan Binding," J Biol Chem 278(49):49261-49270 (2003).
Blundell et al., "Towards a Structure for a TSG-6 Hyaluronan Complex by Modeling and NMR Spectroscopy," J Biol Chem 280(18):18189-18201 (2005).
Blundell et al., "Determining the Molecular Basis for the pH-dependent Interaction between the Link Module of Human TSG-6 and Hyaluronan," J Biol Chem 282:12976-12988 (2007).
Boerner et al., "Production of antigen-specific human monoclonal antibodies from in vitro-primed human splenocytes," J. Immunol. 147(1):86-95 (1991).
Bordier et al., "Phase separation of integral membrane proteins in Triton X-114 solution," J. Biol. Chem., 256(4):1604-1607 (1981).
Brennan et al., "Preparation of bispecific antibodies by chemical recombination of monoclonal immunoglobulin G1 fragments," Science 229(4708):81-83 (1985).
Brinster et al., "Regulation of metallothionein-thymidine kinase fusion plasmids injected into mouse eggs," Nature 296:39-42 (1982).
Brumeanu et al., "Derivatization with monomethoxypolyethylene glycol of Igs expressing viral epitopes obviates adjuvant requirements," J Immunol. 154:3088-3095 (1995).
Caliceti, P. and F. Veronese, "Pharmacokinetic and biodistribution properties of poly(ethylene glycol)-protein conjugates," Adv. Drug Deliv. Rev. 55(10):1261-1277 (2003).
Callahan et al., "Anti-CTLA-4 antibody therapy: immune monitoring during clinical development of a novel immunotherapy," Semin Oncol. 37(5):473-484 (2010).
Callahan et al., "At the bedside: CTLA-4- and PD-1-blocking antibodies in cancer immunotherapy," J Leukocyte Biol 94(1):41-53 (2013).
Camp et al., "Automated subcellular localization and quantification of protein expression in tissue microarrays," Nature Medicine 8(11):1323-1328 (2002).
Carrillo, H. and D. Lipman, "The multiple-sequence alignment problem in biology," SIAM J Applied Math 48(5):1073-1082 (1988).
Carter et al., "High level *Escherichia coli* expression and production of a bivalent humanized antibody fragment," Biotechnology 10(2):163-167 (1992).
Chapman et al., "Therapeutic antibody fragments with prolonged in vivo half-lives," Nature Biotech. 17:780-783 (1999).
Cheng et al., "PEGylated adenoviruses for gene delivery to the intestinal epithelium by the oral route," Pharm. Res. 20(9):1444-1451 (2003).
Cherr et al., "The dual functions of GPI-anchored PH-20: hyaluronidase and intracellular signaling," Matrix Biology 20(8):515-525 (2001).

(56) References Cited

OTHER PUBLICATIONS

Chiu et al., "Advanced pancreatic cancer: Flourishing novel approaches in the era of biological therapy," Oncologist 19(9):937-950 (2014).
Chothia and Lesk, "Canonical structures for the hypervariable regions of immunoglobulins," J. Mol. Biol. 196(4):901-917 (1987).
Clark-Curtiss and Curtiss, "Analysis of recombinant DNA using *Escherichia coli* minicells," Methods Enzymol, 101:347-362 (1983).
Clay et al., "Assays for monitoring cellular immune responses to active immunotherapy of cancer," Clin Cancer Res. 7(5):1127-1135 (2001).
Cole et al., "Human monoclonal antibodies," Mol Cell Biochem. 62(2):109-20 (1984).
Colley et al., "Conversion of a Golgi apparatus sialyltransferase to a secretory protein by replacement of the NH2-terminal signal anchor with a signal peptide" J. Biol. Chem. 264(30): 17619-17622 (1989).
Coloma et al., "Novel vectors for the expression of antibody molecules using variable regions generated by polymerase chain reaction" J Immunol. Methods, 152:89-104 (1992).
Cote et al., "Generation of human monoclonal antibodies reactive with cellular antigens," Proc. Natl. Acad. Sci. USA 80(7): 2026-2030 (1983).
Danilkovitch-Miagkova, et al., "Hyaluronidase 2 negatively regulates RON receptor tyrosine kinase and mediates transformation of epithelial cells by jaagsiekte sheep retrovirus," Proc Natl Acad Sci USA. 100(8):4580-4585 (2003).
Daubenmerkl et al., "Comparative Analyses of Commercial Hyaluronidase Preparations, by both Viseosimetrie and Turbidimetric Methods. With a Note on Hyaluronidase Standards," Acta pharmacol. et toxicol. 13:1-11 (1957).
DeBoer et al., "The tac promoter: a functional hybrid derived from the trp and lac promoters," Proc. Natl. Acad. Sci. USA 80:21-25 (1983).
Delpech et al., "Enzyme-linked hyaluronectin: a unique reagent for hyaluronan assay and tissue location and for hyaluronidase activity detection," Anal Biochem. 229:35-41 (1995).
Derelanko, M.J. "Toxicologist's Pocket Handbook," CRC Press, Boca Raton (2000) p. 16.
Devereux, J., et al, "A comprehensive set of sequence analysis programs for the VAX," Nucleic Acids Research 12(1):387-395 (1984).
Edward et al., "4-Methylumbelliferone inhibits tumour cell growth and the activation of stromal hyaluronan synthesis by melanoma cell-derived factors," Br. J. Dermatol. 162(6): 1224-32 (2010).
Eisenhaber et al., "Prediction of potential GPI-modification sites in proprotein sequences," J Mol Biol 292(3):741-758 (1999).
Eisenhauer et al., "New response evaluation criteria in solid tumours: revised RECIST guideline (version 1.1)," Eur J Cancer 45(2):228-247 (2009).
Eliasson et al., "Chimeric IgG-binding receptors engineered from staphylococcal protein A and streptococcal protein G," J. Biol. Chem. 263(9):4323-4327 (1988).
Englebienne, P, "Use of colloidal gold surface plasmon resonance peak shift to infer affinity constants from the interactions between protein antigens and antibodies specific for single or multiple epitopes" Analyst 123:1599-1603 (1998).
Ernst et al., "Enzymatic degradation of glycosaminoglycans," Critical Reviews in Biochemistry and Molecular Biology 30(5):387-444 (1995).
Fankhauser et al., "Identification of GPI anchor attachment signals by a Kohonen self-organizing map," Bioinformatics 21(9): 1846-52 (2005).
Felix et al., "Pegylated peptides. IV. Enhanced biological activity of site-directed pegylated GRF analogs," Int. J. Peptide Res. 46:253-264 (1995).
Fletcher et al., "Antinociceptive effect of bupivacaine encapsulated in poly(D,L)-lactide-co-glycolide microspheres in the acute inflammatory pain model of carrageenin-injected rats," Anesth. Analg. 84(1):90-4 (1997).

Frost et al., "Purification, cloning, and expression of human plasma hyaluronidase," Biochem. Biophys. Res. Commun. 236:10-15 (1997).
Frost et al., "A microtiter-based assay for hyaluronidase activity not requiring specialized reagents," Anal. Biochem., 251:263-269 (1997).
Frost, G., "Recombinant human hyaluronidase (rHuPH20): an enabling platform for subcutaneous drug and fluid administration," Expert Opin. Drug. Deliv. 4(4):427-440 (2007).
Gardner et al., "The complete nucleotide sequence of an infectious clone of cauliflower mosaic virus by M13mp7 shotgun sequencing," Nucleic Acids Res. 9(12):2871-2888 (1981).
Gilbert, W. and L. Villa-Komaroff, "Useful Proteins from Recombinant Bacteria," Scientific American 242(4):74-94 (1980) [11 pages].
Gilboa et al., "Use of oligonucleotide aptamer ligands to modulate the function of immune receptors," Clin Cancer Res 19(5):1054-1062 (2013).
Gribskov, M. and R. Burgess, "Sigma factors from *E. coli*, B. subtilis, phage SP01, and phage T4 are homologous proteins," Nucl. Acids Res. 14:6745-6763 (1986).
Griffin, A.M. and Griffin, H.G. (eds) "Methods in Molecular Biology, vol. 24: Computer Analysis of Sequence Data, Part I." New Jersey: The Humana Press, Inc. pp. 1-8 (1994).
Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).
Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).
Hamid and Carvajal, "Anti-programmed death-1 and anti-programmed death-ligand 1 antibodies in cancer therapy," Expert Opin. Bio. Ther. 13(6):847-61 (2013).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature 315(6015):115-122 (1985).
Harris, J. and R. Chess, "Effect of pegylation on pharmaceuticals," Nat Rev Drug Discov 2(3):214-221 (2003).
Heldin et al., "High interstitial fluid pressure—an obstacle in cancer therapy," Nat. Rev. Cancer 4(10):806-13 (2004).
Herrera-Estrella et al., "Expression of chimaeric genes transferred into plant cells using a ti-plasmid-derived vector," Nature 303:209-213 (1983).
Herrera-Estrella et al., "Light-inducible and chloroplast-associated expression of a chimaeric gene introduced into Nicotiana tabacum using a Ti plasmid vector," Nature 310(5973):115-120 (1984).
Hibi et al., "Chondroitinase C activity of *Streptococcus intermedius*," FEMS-Microbiol-Lett. 48(2):121-124 (1989).
Hoogenboom and Winter, "By-passing immunisation: Human antibodies from synthetic repertoires of germline VH gene segments rearranged in vitro," J Mol Biol 227(2):381-388 (1992).
Hovingh, P. and A. Linker, "Hyaluronidase activity in leeches (*Hirudinea*)," Comp Biochem Physiol B Biochem Mol Biol. 124(3):319-326 (1999).
Huang et al., "Claudin-3 gene silencing with siRNA suppresses ovarian tumor growth and metastasis," Proc Natl Acad Sci USA. 106(9):3426-3430 (2009).
Huang et al., "The application of allometric scaling principles to predict pharmacokinetic parameters across species," Expert Opin. Drug Metab. Toxicol. 10(9):1241-53 (2014).
Itano et al., "Abnormal accumulation of hyaluronan matrix diminishes contact inhibition of cell growth and promotes cell migration," Proc. Natl. Acad. Sci. USA. 99(6):3609-14 (2002).
IUPAC-IUB Commission on Biochemical Nomenclature, "A One-Letter Notation for Amino Acid Sequences: Tentative Rules," J. Biol. Chem. 243:3557-3559 (1968).

(56) References Cited

OTHER PUBLICATIONS

IUPAC-IUB, "Abbreviated nomenclature of synthetic poypeptides-polymerized amino acids-revised recommendations," Commission on Biochemical Nomenclature, Biochemistry 11:1726-1731 (1972).
Jacobetz et al., "Hyaluronan impairs vascular function and drug delivery in a mouse model of pancreatic cancer," Gut 62(1):112-120 (2013).
James et al., "Visualizing antigen specific CD4+ T cells using MHC class II tetramers," J Vis Exp. (25):1167 (2009), 5 pages.
Jay et al., "Construction of a general vector for efficient expression of mammalian proteins in bacteria: use of a synthetic ribosome binding site," Proc. Natl. Acad. Sci. USA 78:5543-5548 (1981).
Jiang et al., "Effective targeting of the tumor microenvironment for cancer therapy," Anticancer Res. 32(4):1203-1212 (2012).
Jinushi et al., "MFG-E8-mediated uptake of apoptotic cells by APCs links the pro- and antiinflammatory activities of GM-CSF," J Clin Invest 117(7):1902-1913 (2007).
Jones et al., "Replacing the complementarity-determining regions in a human antibody with those from a mouse," Nature 321(6069):522-525 (1986).
Kahmann et al., "Localization and characterization of the hyaluronan-binding site on the Link module from human TSG-6," Structure 8(7):763-774 (2000).
Karvinen et al., "Hyaluronan, CD44 and versican in epidermal keratinocyte tumours," British Journal of Dermatology 148(1):86-94 (2003).
Kastern et al., "Structure of peptostreptococcal protein L and identification of a repeated immunoglobulin light chain-binding domain," J. Biol. Chem. 267(18):12820-12825 (1992).
Keir et al., "PD-1 and its ligands in tolerance and immunity," Annu Rev Immunol 26:677-704 (2008).
Kelsey et al., "Species- and tissue-specific expression of human alpha 1-antitrypsin in transgenic mice," Genes and Devel. 1:161-171 (1987).
Kipriyanov, "Methods in Molecular Biology, vol. 207: Recombinant Antibodies for Cancer Therapy: Methods and Protocols," Humana Press Inc. (2003); Chapter 1; pp. 3-25.
Kirkwood et al., "Phase II trial of tremelimumab (CP-675,206) in patients with advanced refractory or relapsed melanoma," Clin Cancer Res 16(3):1042-1048 (2010).
Kohda et al., "Solution structure of the link module: a hyaluronan-binding domain involved in extracellular matrix stability and cell migration," Cell 86(5): 767-775 (1996).
Kohler, G. and C. Milstein, "Continuous cultures of fused cells secreting antibody of predefined specificity," Nature 256:495-497 (1975).
Kollias et al., "Regulated expression of human A gamma-, beta-, and hybrid gamma beta-globin genes in transgenic mice: manipulation of the developmental expression patterns," Cell 46:89-94 (1986).
Kozbor et al., "Specific immunoglobulin production and enhanced tumorigenicity following ascites growth of human hybridomas," J Immunol Methods 81(1):31-42 (1985).
Kruisbeek et al., "Proliferative assays for T cell function," Curr Protoc Immunol. Chapter 3:Unit 3.12 (2004), 20 pages.
Krumlauf et al., "Developmental regulation of alpha-fetoprotein genes in transgenic mice," Mol. Cell. Biol. 5(7):1639-1648 (1985).
Krupers et al., "Complexation of poly(ethylene oxide) with poly(acrylic acid-co-hydroxyethyl methacrylate)s," Eur. Polym J. 32(6):785-790 (1996).
Kuang et al., "Tumor-derived hyaluronan induces formation of immunosuppressive macrophages through transient early activation of monocytes," Blood 110(2):587-95 (2007).
Kultti et al., "Therapeutic targeting of hyaluronan in the tumor stroma," Cancers 4(3):873-903 (2012).
Kyi et al., "Checkpoint blocking antibodies in cancer immunotherapy," FEBS Letters 588:368-376 (2014).
Lalancette et al., "Characterization of an 80-kilodalton bull sperm protein identified as PH-20," Biol Reprod. 65(2):628-636 (2001).

Leder et al., "Consequences of widespread deregulation of the c-myc gene in transgenic mice: multiple neoplasms and normal development," Cell 45:485-495 (1986).
Lee et al., "A novel secretory tumor necrosis factor-inducible protein (TSG-6) is a member of the family of hyaluronate binding proteins, closely related to the adhesion receptor CD44," J Cell Biol. 116(2):545-557 (1992).
Lesley et al., "TSG-6 modulates the interaction between hyaluronan and cell surface CD44," J Biol Chem 279(24): 25745-25754 (2004).
Liliom et al., "Quantitative evaluation of indirect ELISA. Effect of calmodulin antagonists on antibody binding to calmodulin," J. Immunol Methods. 143(1):119-125 (1991).
Lipponen et al., "High stromal hyaluronan level is associated with poor differentiation and metastasis in prostate cancer," Eur. Journal of Cancer 37(7): 849-856 (2001).
Liu et al., "Recovery and purification process development for monoclonal antibody production," mAbs 2(5):480-499 (2010).
Lokeshwar et al., "Tumor-associated hyaluronic acid: a new sensitive and specific urine marker for bladder cancer," Cancer Res 57(4):773-7 (1997).
Lu, Y. and A. Felix, "Pegylated peptides I: Solid-phase synthesis of N alpha-pegylated peptides using Fmoc strategy," Peptide Res 6:140-146 (1993).
Lu, Y. and A. Felix, "Pegylated peptides II. Solid-phase synthesis of amino-, carboxy- and side-chain pegylated peptides," Int. J. Peptide Protein Res. 43(2):127-138 (1994).
Lycke et al., "Measurement of immunoglobulin synthesis using the ELISPOT assay," Curr Protoc Immunol. Chapter 7:Unit 7.14 (2001), 9 pages.
Macdonald, R., "Expression of the pancreatic elastase I gene in transgenic mice," Hepatology 7(1):42S-51S (1987).
Maghni et al., "Suitability of cell metabolic colorimetric assays for assessment of CD4+ T cell proliferation: comparison to 5-bromo-2-deoxyuridine (BrdU) ELISA," J. Immunol. Method. 223(2):185-194 (1999).
Magram et al., "Developmental regulation of a cloned adult beta-globin gene in transgenic mice," Nature 315:338-340 (1985).
Mahoney et al., "Mapping the Hyaluronan-binding Site on the Link Module from Human Tumor Necrosis Factor-stimulated Gene-6 by Site-directed Mutagenesis," J Biol Chem 276(25):22764-22771 (2001).
Mahoney et al., "Characterization of the interaction between tumor necrosis factor-stimulated gene-6 and heparin: implications for the inhibition of plasmin in extracellular matrix microenvironments," J Biol Chem 280(29):27044-55 (2005).
Malmqvist, "BIACORE: an affinity biosensor system for characterization of biomolecular interactions" Biochem. Soc. Trans. 27:335-340 (1999).
Marasco et al., "Design, intracellular expression, and activity of a human anti-human immunodeficiency virus type 1 gp120 single-chain antibody," Proc. Natl. Acad. Sci. USA 90(16):7889-7893 (1993).
Marks et al., "By-passing immunization. Human antibodies from V-gene libraries displayed on phage," J Mol Biol. 222(3):581-597 (1991).
Martin et al., "Modeling antibody hypervariable loops: a combined algorithm," Proc Natl Acad Sci USA 86(23):9268-9272 (1989).
Martin et al., "Molecular modeling of antibody combining sites," Methods Enzymol 203:121-153 (1991).
Mason et al., "The hypogonadal mouse: reproductive functions restored by gene therapy," Science 234:1372-1378(1986).
McBride and Bard, "Hyaluronidase-sensitive halos around adherent cells. Their role in blocking lymphocyte-mediated cytolysis," J Exp Med. 149(2):507-515 (1979).
Mehvar et al., "Modulation of the pharmacokinetics and pharmacodynamics of proteins by polyethylene glycol conjugation," J. Pharm. Pharmaceut. Sci. 3(1):125-136 (2000).
Melief et al., "Therapeutic cancer vaccines," J Clin Invest. 125(9):3401-12 (2015).
Michelacci, Y. and C. Dietrich, "Chondroitinase C from Flavobacterium heparinum," J. Biol. Chem. 251(4):1154-1158 (1976).
Miller et al., "Reporting results of cancer treatment," Cancer 47(1):207-214 (1981).

(56) References Cited

OTHER PUBLICATIONS

Milner and Day, "TSG-6: a multifunctional protein associated with inflammation," Journal of Cell Science 116:1863-1873 (2003).
Molina et al., "Global proteomic profiling of phosphopeptides using electron transfer dissociation tandem mass spectrometry," Proc Natl Acad Sci USA 104(7):2199-2204 (2007).
Molineux, G., "Pegylation: engineering improved biopharmaceuticals for oncology," Pharmacotherapy 23 (8 Pt 2):3S-8S (2003).
Monfardini et al, "A branched monomethoxypoly(ethylene glycol) for protein modification," Bioconjugate Chem. 6: 62-69 (1995).
Morimoto and Inouye, "Single-step purification of F(ab')2 fragments of mouse monoclonal antibodies (immunoglobulins G1) by hydrophobic interaction high performance liquid chromatography using TSKgel Phenyl-5PW" J Biochem Biophys Methods 24(1-2):107-117 (1992).
Morrison, "Transformation in *Escherichia coli*: cryogenic preservation of competent cells," J. Bact. 132:349-351 (1977).
Munson et al., "Ligand: a versatile computerized approach for characterization of ligand-binding systems," Anal. Biochem., 107:220-239 (1980).
Needleman, S. and C. Wunsch, "A general method applicable to the search for similarities in the amino acid sequence of two proteins," A general method applicable to the search for similarities in the amino acid sequence of two proteins, J Mol Biol. 48:443-453 (1970).
Nentwich et al., "A Novel Allelic Variant of the Human TSG-6 Gene Encoding an Amino Acid Difference in the CUB Module. Chromosomal localization, frequency analysis, modeling, and expression," J Biol Chem 277(18):15354-62 (2002).
Nishino et al., "Developing a Common Language for Tumor Response to Immunotherapy: Immune-related Response Criteria using Unidimentional measurements," Clin Cancer Res 19(14):3936-3943 (2013).
Ohya, T., and Y. Kaneko, "Novel hyaluronidase from streptomyces," Biochim. Biophys. Acta 198:607-609 (1970).
Omaetxebarria et al., "Computational approach for identification and characterization of GPI-anchored peptides in proteomics experiments," Proteomics 7(12):1951-60 (2007).
Orlandi et al., "Cloning immunoglobulin variable domains for expression by the polymerase chain reaction," Proc. Natl. Acad. Sci. USA 86(10): 3833-3837 (1989).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Pack et al., "Improved bivalent miniantibodies, with identical avidity as whole antibodies, produced by high cell density fermentation of *Escherichia coli*," Biotechnology 11:1271-1277 (1993).
Pardoll, D.M., "The blockade of immune checkpoints in cancer immunotherapy," Nat Rev Cancer 12(4):252-264 (2012).
Paul, ed., Fundamental Immunology, 2nd ed., "Chapter 12, Antigen-Antibody Interactions," Raven Press, New York, pp. 332-336 (1989).
Pearson, W. and D. Lipman "Improved tools for biological sequence comparison," Proc. Natl. Acad. Sci. USA 85:2444-2448 (1988).
Pedersen et al., "Antibody modeling: Beyond homology," ImmunoMethods 1(2):126-136 (1992).
Pham et al., "Large-scale transient transfection of serum-free suspension-growing HEK293 EBNA1 cells: peptone additives improve cell growth and transfection efficiency," Biotechnology and Bioengineering 84(3):332-342 (2003).
Pierleoni et al., "PredGPI: a GPI-anchor predictor," BMC Bioinformatics 9:392 (2008), 11 pages.
Pinkert et al., "An albumin enhancer located 10 kb upstream functions along with its promoter to direct efficient, liver-specific expression in transgenic mice," Genes and Devel. 1:268-276 (1987).
Pirinen et al., "Prognostic value of hyaluronan expression in non-small-cell lung cancer: Increased stromal expression indicates unfavorable outcome in patients with adenocarcinoma," Int J Cancer 95(1):12-17 (2001).
Plenat et al., "Formaldehyde fixation in the third millennium," Ann Pathol 21(1):29-47 (2001) [in French], 19 pages.
Plenat et al., "Formaldehyde fixation in the third millennium," Ann Pathol 21(1):29-47 (2001) [English Abstract], 1 page.
Presta, "Antibody Engineering," Curr Op Struct Biol 2(4):593-596 (1992).
Prieto et al., "CTLA-4 blockade with ipilimumab: long-term follow-up of 177 patients with metastatic melanoma," Clin Cancer Res 18(7):2039-2047 (2012).
Quezada et al., "Exploiting CTLA-4, PD-1 and PD-L1 to reactivate the host immune response against cancer," Br J Cancer 108(8):1560-1565 (2013).
Readhead et al., "Expression of a myelin basic protein gene in transgenic shiverer mice: correction of the dysmyelinating phenotype," Cell 48:703-712 (1987).
Rich and Myszka, "Advances in surface plasmon resonance biosensor analysis," Curr. Opin. Biotechnol 11(1):54-61 (2000).
Riechmann et al., "Reshaping human antibodies for therapy," Nature 332:323-327 (1988).
Roberts et al., "Chemistry for peptide and protein PEGylation," Advanced Drug Delivery Reviews 54:459-476 (2002).
Ropponen et al., "Tumor cell-associated hyaluronan as an unfavorable prognostic factor in colorectal cancer," Cancer Research 58(2):342-347 (1998).
Rozali et al., "Programmed Death Ligand 2 in Cancer-Induced Immune Suppression," Clin. Dev. Immunol. 2012:656340 (2012).
Santulli-Marotto et al., "Multivalent RNA aptamers that inhibit CTLA-4 and enhance tumor immunity," Cancer Res. 63(21):7483-7489 (2003).
Sato et al., "Cloning and expression in *Escherichia coli* of the gene encoding the Proteus vulgaris chondroitin ABC lyase," Appl. Microbiol. Biotechnol. 41(1):39-46 (1994).
Sato, H., "Enzymatic procedure for site-specific pegylation of proteins," Adv. Drug Deliv. Rev. 54:487-504 (2002).
Sawhney et al., "Bioerodible hydrogels based on photopolymerized poly(ethylene glycol)-co-poly(hydroxyl acid) Diacrylate Macromers," Macromolecules 26:581-587 (1993).
Scatchard et al., "The Attraction of Proteins for Small Molecules and Ions," Ann N.Y. Acad. Sci, 51:660-672 (1949).
Schwartz, R. and M. Dayhoff, eds., "Matrices for detecting distant relationships," found in: Atlas of Protein Sequence and Structure, National Biomedical Research Foundation, pp. 353-358 (1978).
Scodeller, P., "Hyaluronidase and other extracellular matrix degrading enzymes for cancer therapy: new uses and nano-formulations," J Carcinog Mutage 5(4): 1-5 (2014).
Shani, M., "Tissue-specific expression of rat myosin light-chain," Nature 314:283-286 (1985).
Smith, D. W. (Ed.), "Computational simulations of biological systems," found in: Biocomputing: Informatics and Genome Projects (pp. 269-305). New York NY: Academic Press (1993).
Smith, T. and M. Waterman, "Comparison of biosequences," Advances in Applied Mathematics 2:482-489 (1981).
Snell et al., "T-cell intrinsic effects of GITR and 4-1BB during viral infection and cancer immunotherapy," Immunol. Rev. 244:197-217 (2011).
Swift et al., "Tissue-specific expression of the rat pancreatic elastase I gene in transgenic mice," Cell 38:639-646 (1984).
Takahashi et al., "A Fluorimetric Morgan-Elson Assay Method for Hyaluronidase Activity," Anal Biochem. 322(2):257-263 (2003).
Tan et al., "Engineering a novel secretion signal for cross-host recombinant protein expression," Protein Eng. 15(4):337-345 (2002).
Tiller et al., "Efficient generation of monoclonal antibodies from single human B cells by single cell RT-PCR and expression vector cloning," J Immunol. Methods 329(1-2):112-124 (2008).
Tkalec et al., "Isolation and expression in *Escherichia coli* of cslA and cslB, genes coding for the chondroitin sulfate-degrading enzymes chondroitinase AC and chondroitinase B, respectively, from Flavobacterium heparinum," Applied and Environmental Microbiology 66(1):29-35 (2000).
Tsubery et al., "Prolonging the action of protein and peptide drugs by a novel approach of reversible polyethylene glycol modification," J Biol. Chem 279(37):38118-38124 (2004).

(56) References Cited

OTHER PUBLICATIONS

Tsuda et al., "Substrate specificity studies of flavobacterium chondroitinase C and heparitinases towards the glycosaminoglycan-protein linkage region. Use of a sensitive analytical method developed by chromophore-labeling of linkage glycoserines using dimethylaminoazobenzenesulfonyl chloride," Eur. J. Biochem. 262:127-133 (1999).
Tyle, P., "Iontophoretic devices for drug delivery," Pharmaceutical Research 3(6):318-326 (1986).
Udenfriend, S. and K. Kodukula, "Prediction of omega site in nascent precursor of glycosylphosphatidylinositol protein," Methods Enzymol. 250:571-582 (1995).
USP XXII-NF XVII (1990) United States Pharmacopeia Convention, Inc, Rockville, MD, pp. 644-645.
Veiseh et al., "Cellular heterogeneity profiling by hyaluronan probes reveals an invasive but slow-growing breast tumor subset," Proc. Natl. Acad. Sci. U.S.A. 111(17) E1731-E1739 (2014).
Verhoeyen et al., "Reshaping human antibodies: grafting an antilysozyme activity," Science 239:1534-1536 (1988).
Veronese et al., "Branched and Linear Poly(Ethylene Glycol): Influence of the Polymer Structure on Enzymological, Pharmacokinetic, and Immunological Properties of Protein Conjugates," J. Bioactive Compatible Polymers 12:196-207 (1997).
Vigneron et al., "Database of T cell-defined human tumor antigens: the 2013 update," Cancer Immun. 13:15-20 (2013).
Vinay et al., "Immunotherapy of cancer with 4-1BB," Mol. Cancer Ther. 11(5):1062-1070 (2012).
Wagner et al., "Nucleotide sequence of the thymidine kinase gene of herpes simplex virus type 1," Proc. Natl. Acad. Sci. USA 78(3):1441-1445 (1981).
Watson et al., Molecular Biology of the Gene, 4th Edition, The Benjamin/Cummings Pub. co., p. 224 (1987).
Weinberg et al., "Science gone translational: the OX40 agonist story," Immunol Rev 244(1):218-231 (2011).
Whitlow and Filpula, "Single-Chain Fv Proteins and Their Fusion Proteins," Methods 2(2):97-105 (1991).
Winter and Milstein, "Man-made antibodies," Nature 349:293-299 (1991).
Wolchok et al., "Guidelines for the Evaluation of Immune Therapy Activity in Solid Tumors: Immune-Related Response Criteria," Clin Cancer Res. 15(23): 7412-7420 (2009).
World Health Organization, "WHO handbook for reporting results of cancer treatment," WHO offset publication ; No. 48, Geneva pp. 1-45 (1979).
Wulfing et al., "Visualizing the dynamics of T cell activation: Intracellular adhesion molecule 1 migrates rapidly to the T cell/B cell interface and acts to sustain calcium levels," Proc. Natl. Acad. Sci. USA 95(11):6302-6307 (1998).
Yamagata et al., "Purification and properties of bacterial chondroitinases and chondrosulfatases," J. Biol. Chem. 243(7):1523-1535 (1968).
Yamamoto et al., "Identification of a functional promoter in the long terminal repeat of Rous sarcoma virus," Cell 22:787-797 (1980).
Yang et al., "Purification and characterization of heparinase from Flavobacterium heparinum," J. Biol. Chem. 260(30):1849-1857 (1985).
Zalipsky, S., "Chemistry of polyethylene glycol conjugates with biologically active molecules," Adv. Drug Del. Rev. 16:157-182 (1995).
Zhao et al., "Novel Degradable Poly(ethylene glycol) Esters for Drug Delivery," ACS Symposium Series 680:458-472 (1997).
Zou and Chen, "Inhibitory B7-family molecules in the tumour microenvironment," Nat. Rev. Immunol. 8(6):467-77 (2008).
Bazhenova et al., "A Phase 1b study of PEGPH20 plus pembrolizumab in patients with selected hyaluronan-high solid tumors," presented at AACR Annual Meeting, Apr. 3, 2017 [Retrieved Apr. 4, 2017]. Washington D.C. Abstract #CT032, 2 pages.
Clift et al., "PEGylated recombinant hyaluronidase PH20 (PEGPH20) enhances tumor infiltrating CD8+ T cell accumulation and improves checkpoint inhibitor efficacy in murine syngeneic breast cancer models," presented at AACR Annual Meeting, Apr. 2, 2017. Washington D.C. Abstract #50/1 [retrieved Mar. 17, 2017; available online Mar. 1, 2017], 1 page.
"PEGPH20: The Science & the Strategy," presented at J. P. Morgan Healthcare Conference on Jan. 7, 2015. Presentation. 81 pages.
Rosengren et al., "PEGylated recombinant hyaluronidase PH20 (PEGPH20) enhances checkpoint inhibitor efficacy in syngeneic mouse models of cancer," presented at AACR Annual Meeting, Apr. 20, 2016. New Orleans, LA. Abstract #4886 [Published online on Mar. 28, 2016 and Retrieved from the internet on Mar. 28, 2016], 1 page.
Rosengren et al., "PEGylated recombinant hyaluronidase PH20 (PEGPH20) enhances checkpoint inhibitor efficacy in syngeneic mouse models of cancer," presented at AACR Annual Meeting, Apr. 20, 2016. New Orleans, LA. Poster #4886 [poster and enlarged individual panels], 13 pages.
Singha et al., "Hyaluronan (HA) depletion increases tumor accessibility of T cell and therapeutic PD-L1 monoclonal antibody in HA high tumors," presented at AACR Annual Meeting 2015, Apr. 19, 2015, Philadelphia, PA. Abstract #982, 2 pages.
Singha et al., "PEGPH20 depletion of pericellular hyaluronan sensitizes high hyaluronan-producing tumor cells in antibody-dependent cell-mediated cytotoxicity," [abstract] In: Proceedings of the AACR Special Conference on Molecularly Targeted Therapies: Mechanisms of Resistance; May 9-12, 2012; San Diego, CA. Philadelphia (PA): AACR; Clin Cancer Res 2012; 18(10 Suppl):Abstract B6, 2 pages.
Singha et al., "Hyaluronan-rich ECM contributes to resistance to antibody-dependent cell-mediated cytotoxicity in solid tumors," [abstract] In: Proceedings of the 104th Annual Meeting of the American Association for Cancer Research; Apr. 6-10, 2013; Washington, DC. Philadelphia (PA): AACR; Cancer Res 2013;73(8 Suppl):Abstract 4999, 4 page.
Torley et al., "American Association for Cancer Research Investor Meeting," presented at AACR Annual Meeting, Apr. 18, 2016. New Orleans, LA [presentation], 91 pages.
Torley H.,"Building a premier oncology biotech: two pillar strategy for growth," retrieved from URL:halozyme.com/files/doc_presentations/2016/Halozyme-Overview-09-22-16_Website.pdf [retrieved on Jan. 17, 2017], 30 pages.
Thanos C., "Hyaluronan (HA) depletion increases tumor accessibility of T cell and anti-PD-L1 mAb in Ha$^{high}$ Tumors," presented at AACR Meeting, Apr. 18-22, 2015, Philadelphia, PA [presentation], 15 pages.
News Release, Halozyme Therapeutics, Inc., "Halozyme Therapeutics Provides an Update on Anticipated Milestones for 2015 at the 33rd Annual J. P. Morgan Healthcare Conference," Published Jan. 12, 2015 [online], Retrieved from: <URL: halozyme.com/Investors/News-Releases/News-Release-Details/2015/Halozyme-Therapeutics-Provides-An-Update-On-Anticipated-Milestones-For-2015-At-The-33rd-Annual-J-P-Morgan-Healthcare-Conference/default.aspx [retrieved on Jan. 14, 2015], 3 pages.
News Release, Halozyme Therapeutics, Inc., "Halozyme Presents New Preclinical Data at the American Association for Cancer Research Annual Meeting, Announces Clinical Data Presentation at ASCO," Published Apr. 20, 2015 [online], Retrieved from: <URL: halozyme.com/Investors/News-Releases/News-Release-Details/2015/Halozyme-Presents-New-Preclinical-Data-At-The-American-Association-for-Cancer-Research-Annual-Meeting-Announces-Clinical-Data-Presentation-At-ASCO/default.aspx [retrieved on Apr. 20, 2015], 4 pages.
News Release, Halozyme Therapeutics, Inc., "First Patient Dosed in Clinical Trial of Halozyme Investigational Drug PEGPH20 in Combination With Merck Immuno-oncology Drug KEYTRUDA," Published Nov. 5, 2015 [online], Retrieved from: <URL: halozyme.com/Investors/News-Releases/News-Release-Details/2015/First-Patient-Dosed-in-Clinical-Trial-of-Halozyme-Investigational-Drug-PEGPH20-in-Combination-With-Merck-Immuno-oncology-Drug-KEYTRUDA/default.aspx [retrieved on Nov. 5, 2015], 3 pages.
News Release, Halozyme Therapeutics, Inc., "Halozyme to Present Data from Five Preclinical Studies at American Association of Cancer Research Annual Conference," Published Mar. 17, 2016 [online], Retrieved from: <URL:halozyme.com/investors/news-

(56) References Cited

OTHER PUBLICATIONS releases/news-release-details/2016/Halozyme-To-Present-Data-From-Five-Preclinical-Studies-At-American-Association-Of-Cancer-Research-Annual-Conference/default.aspx [retrieved on Mar. 28, 2016], 5 pages.
News Release, Halozyme Therapeutics, Inc., "Halozyme Resumes Patient Enrollment and Dosing in PEGPH20 Clinical Trial With KEYTRUDA," Published Jul. 25, 2016, 2016 [online], Retrieved from: <URL:halozyme.com/investors/news-releases/news-release-details/2016/Halozyme-Resumes-Patient-Enrollment-And-Dosing-In-PEGPH20-Clinical-Trial-With-KEYTRUDA/default.aspx [retrieved on Jul. 26, 2016], 3 pages.
News Release, Halozyme Therapeutics, Inc., "Halozyme Reports Second Quarter 2016 Financial Results," Published Aug. 9, 2016 [online], Retrieved from: <URL:prnewswire.com/news-releases/halozyme-reports-second-quarter-2016-financial-results-300311374.html [retrieved on Aug. 31, 2016], 10 pages.
News Release, Halozyme Therapeutics, Inc., "Halozyme announces broad clinical collaboration agreement to evaluate PEGPH20 and Tecentriq in up to eight tumor types," Published Nov. 10, 2016 [online], Retrieved from: <URL: halozyme.com/investors/news-releases/news-release-details/2016/Halozyme-Announces-Broad-Clinical-Collaboration-Agreement-To-Evaluate-PEGPH20-And-Tecentriq-In-Up-To-Eight-Tumor-Types/default.aspx [retrieved on Nov. 11, 2016], 3 pages.
News Release, Halozyme Therapeutics, Inc., "Halozyme PEGPH20 Increases Immune Response and Effectiveness of Immunotherapies in Preclinical Cancer Models," Published Apr. 3, 2017 [online], Retrieved from: <URL: halozyme.com/investors/news-releases/news-release-details/2017/Halozymes-PEGPH20-Increases-Immune-Response-and-Effectiveness-of-Immunotherapies-in-Preclinical-Cancer-Models/default.aspx [retrieved on Apr. 3, 2017], 5 pages.
International Search Report and Written Opinion, dated Nov. 4, 2015, in connection with International Patent Application No. PCT/US2015/047588, 14 pages.
Response, filed Jun. 27, 2016, to International Search Report and Written Opinion, dated Nov. 4, 2015, in connection with International Patent Application No. PCT/US2015/047588, 44 pages.
Written Opinion of the International Preliminary Examing Authority (PCT Rule 66), dated Jul. 15, 2016, in connection with International Patent Application No. PCT/US2015/047588, 5 pages.
Response, filed Sep. 15, 2016 to Written Opinion of the International Preliminary Examing Authority (PCT Rule 66), dated Jul. 15, 2016, in connection with International Patent Application No. PCT/US2015/047588, 38 pages.
International Preliminary Report on Patentability (PCT Rule 71.1), dated Nov. 21, 2016, in connection with International Patent Application No. PCT/US2015/047588, 8 pages.
Letter/Written Disclosure of the Supplemental Information Disclosure Statement for the above-referenced application, filed herewith on Jan. 11, 2019, 2 pages.
Callewaert et al., "Ultrasensitive profiling and sequencing of N-linked oligosaccharides using standard DNA-sequencing equipment," Glycobiology 11(4):275-281 (2001).
DrugBank Accession No. DB06186, Ipilimumab [Biotech], [online] [retrieved on Nov. 4, 2015][retrieved from the Internet: URL:<drugbank.ca/drugs/DB06186], 9 pages.
GenBank Accession No. AAL07473, CTLA4 [*Homo sapiens*], published on Sep. 26, 2001 [online] [retrieved on Nov. 3, 2015][retrieved from: URL:<ncbi.nlm.nih.gov/protein/AAL07473.1], 1 page.
Li et al., "Parallel Accumulation of Tumor Hyaluronan, Collagen, and Other Drivers of Tumor Progression," J Clin Canc Res 24(19): 4798-4807 (2018).
Rabinovich et al., "Immunosuppressive strategies that are mediated by tumor cells," Annu Rev Immunol 25:267-296 (2007).
Singh et al., "Synergistic Antitumor Activity of Anti-CD25 Recombinant Immunotoxin LMB-2 with Chemotherapy," Clin Cancer Res 18(1):152-160 (2012).
Sironen et al., "Hyaluronan in human malignancies," Exp Cell Res 317(4):383-391 (2011).

Thompson et al., "Enzymatic Depletion of Tumor Hyaluronan Induces Antitumor Responses in Preclinical Animal Models," Molecular Cancer Therapeutics 9(11):3052-3064 (2010).
Tlsty et al., "Tumor stroma and regulation of cancer development," Annu Rev Pathol 1:119-150 (2006).
Torley, H.,"Building a Premier Oncology Biotech," Presented Sep. 6, 2018; retrieved from <URL:event.webcasts.com/viewer/event.jsp?ei=1204014&tp_key=220e0a6a38 [retrieved on Sep. 7, 2018], 22 pages.
News Article, "[Promising biocompany] Alteogen Inc. tries to differentiate itself with specialized bio technology and strategy," Published on Sep. 17, 2018 [online] Retrieved from: <URL:edaily.co.kr/news/read?newsId=01105366619341104&mediaCodeNo=257&OutLnkChk=Y [Original documents retrieved from the internet and English translation], 4 pages.
News Release, Halozyme Therapeutics, Inc., "Halozyme Publication in the Journal Clinical Cancer Research Highlights New Nonclinical Data Supporting Multiple Effects of PEGPH20 on the Tumor Microenvironment," Published Oct. 4, 2018 [online] Retrieved from:<URL: halozyme.com/investors/news-releases/news-release-details/2018/Halozyme-Publication-In-The-Journal-Clinical-Cancer-Research-Highlights-New-Nonclinical-Data-Supporting-Multiple-Effects-Of-PEGPH20-On-The-Tumor-Microenvironment/default.aspx [retrieved on Oct. 5, 2018], 4 pages.
News Release, Halozyme Therapeutics, Inc., "Halozyme Announces First Clinical Dosing in Bristol-Myers Squibb's Phase 1 Trial of BMS-986179 With Enhanze® Technology," Published Oct. 25, 2018 [online] Retrieved from:<URL: halozyme.com/investors/news-releases/news-release-details/2018/Halozyme-Announces-First-Clinical-Dosing-In-Bristol-Myers-Squibbs-Phase-1-Trial-Of-BMS-986179-With-Enhanze-Technology/default.aspx [retrieved on Oct. 26, 2018], 5 pages.
News Release, Halozyme Therapeutics, Inc., "Halozyme Licenses New ENHANZE® Targets for $25 Million Upfront Payment, Future Milestones and Royalties," Published Oct. 30, 2018 [online] Retrieved from:<URL: halozyme.com/investors/news-releases/news-release-details/2018/Halozyme-Licenses-New-ENHANZE-Targets-For-25-Million-Upfront-Payment-Future-Milestones-And-Royalties/default.aspx [retrieved on Oct. 30, 2018], 4 pages.
News Article, "Alteogen, Inc. challenges to the ethical drug market by utilizing 'Human Hyaluronidase'," Published on Oct. 29, 2018 [online] Retrieved from: <URL:fnnews.com/news/201810290941498520 [Original documents retrieved from the internet and English translation], 6 pages.
Communication Pursuant to Rule 71(3) EPC (Intention to Grant), dated Oct. 23, 2018, in connection with European Patent Application No. 15760604.7, 7 pages.
Letter/Written Disclosure of the Supplemental Information Disclosure Statement for the above-referenced application, filed herewith on Apr. 15, 2020, 3 pages.
Azanza et al., "Monoclonal antibodies: Pharmacokinetics as a basis for new dosage regimens?" J Onc Pharm Pract 21(5):370-376 (2015).
Hong et al.,"Degradation of tumour stromal hyaluronan by small extracellular vesicle-PH20 stimulates CD103+ dendritic cells and in combination with PD-L1 blockade boosts anti-tumour immunity," J Extracell Vesicles 8(1): 1670893 (2019), 15 pages.
Infante et al., "Phase 1 trials of PEGylated recombinant human hyaluronidase PH20 in patients with advanced solid tumours," Br J Cancer 118(2):153-161 (2018).
Locke et al., "ENHANZE® drug delivery technology: a novel approach to subcutaneous administration using recombinant human hyaluronidase PH20," Drug Deliv 26(1):98-106 (2019).
Singha et al., "Tumor-associated Hyaluronan Limits Efficacy of Monoclonal Antibody Therapy," Mol Cancer Ther. 14(2): 523-532 (2014).
News Release, Halozyme Therapeutics, Inc., "Halozyme Announces HALO-301 Phase 3 Study Fails to Meet Primary Endpoint," Published Nov. 4, 2019 [online], Retrieved from: <URL: halozyme.com/investors/news-releases/news-release-details/2019/Halozyme-Announces-HALO-301-Phase-3-Study-Fails-To-Meet-Primary-Endpoint/default.aspx [retrieved on Nov. 11, 2019], 3 pages.

(56) References Cited

OTHER PUBLICATIONS

Notice of Opposition, filed Jan. 10, 2020, in connection with European Patent Application No. 15760604.7, 52 pages.

Disapproval of Text for Grant, filed Mar. 25, 2020, in connection with European Patent Application No. 15760604.7, 1 page.

Letter/Written Disclosure of the Supplemental Information Disclosure Statement for the above-referenced application, filed herewith on Nov. 18, 2020, 2 pages.

Biswas et al., "Tumor-associated macrophages: Functional diversity, clinical significance, and open questions," Semin. Immunopathol. 35:585-600 (2013).

Clift et al., "Remodeling the Tumor Microenvironment Sensitizes Breast Tumors to Anti-Programmed Death-Ligand 1 Immunotherapy," Cancer Res 79(16):4149-59 (2019).

Edin et al., "The Distribution of Macrophages with a M1 or M2 Phenotype in Relation to Prognosis and the Molecular Characteristics of Colorectal Cancer," PLoS One 7(10):e47045, 12 pages, (2012).

Honkanen et al., "Prognostic and predictive role of tumour-associated macrophages in HER2 positive breast cancer," Scientific Reports 9:10961 (2019), 9 pages.

Hu et al., "CD163 as a marker of M2 macrophage, contribute to predict aggressiveness and prognosis of Kazakh esophageal squamous cell carcinoma," Oncotarget 8(13):21526-21538 (2017).

Kim et al., "Eradication of metastatic mouse cancers resistant to immune checkpoint blockade by suppression of mycloid-dcrived cclls," PNAS 111(32):11774-11779 (2014).

Stern, R., "Hyaluronan catabolism: a new metabolic pathway," E J Cell Biol. 83(7):317-325 (2004) [abstract], 1 page.

Thompson et al., "Increasing tumor infiltrating CD8| T cell response and checkpoint inhibitor efficacy by enzymatic reduction of tumor hyaluronan in a murine syngeneic pancreatic cancer model," Presented at: AACR Meeting Apr. 14-18, 2018, Chicago, IL, Poster B38, 1 page.

Lee et al., "Combination of PEGylated recombinant hyaluronidase PH20 (PEGPH20) with live-attenuated, double-deleted (LADD) Listeria enhances tumor infiltrating CD8+ T cell response and antitumor efficacy in mice," Presented at AACR Annual Meeting on Apr. 4, 2017 [Retrieved on Apr. 4, 2017]. Washington D.C.. Abstract LC-198, 2 pages.

News Release, Halozyme Therapeutics, Inc., "Halozyme Announces Poster Presentation of Data From Roche's Phase lb Study Evaluating Atezolizumab for Subcutaneous Administration Utilizing Enhanze® in Non-Small Cell Lung Cancer," Published Sep. 17, 2020 [online], Retrieved from: <URL:halozyme.com/investors/news-releases/news-release-details/2020/Halozyme-Announces-Poster-Presentation-Of-Data-From-Roches-Phase-l b-Study-Evaluating-Atezolizumab-For-Subcutaneous-Administration-Utilizing-Enhanze-In-Non-Small-Cell-Lung-Cancer/default.aspx [retrieved on Sep. 18, 2020], 3 pages.

Letter/Written Disclosure of the Supplemental Information Disclosure Statement for the above-referenced application, filed herewith on May 21, 2020, 2 pages.

Decision Revoking the European Patent, issued Apr. 2, 2020, in connection with European Patent Application No. 15760604.7, 3 pages.

\* cited by examiner

COMBINATION THERAPY WITH A HYALURONAN-DEGRADING ENZYME AND AN IMMUNE CHECKPOINT INHIBITOR

RELATED APPLICATIONS

This application is a continuation of International PCT Application No. PCT/US15/47588, filed Aug. 28, 2015, to Sanna Rosengren, H. Michael Shepard and Curtis B. Thompson, and entitled "COMBINATION THERAPY WITH A HYALURONAN-DEGRADING ENZYME AND AN IMMUNE CHECKPOINT INHIBITOR," which claims benefit of priority to U.S. Provisional Application Ser. No. 62/043,351, filed Aug. 28, 2014, to Sanna Rosengren, H. Michael Shepard and Curtis B. Thompson, and entitled "COMBINATION THERAPY WITH A HYALURONAN-DEGRADING ENZYME AND AN IMMUNE CHECKPOINT INHIBITOR." The subject matter of the above-noted applications is incorporated by reference in its entirety.

INCORPORATION BY REFERENCE OF SEQUENCE LISTING PROVIDED ELECTRONICALLY

An electronic version of the Sequence Listing is filed herewith, the contents of which are incorporated by reference in their entirety. The electronic file was created on Feb. 22, 2017, is 904 kilobytes in size, and titled 3122SEQ001.txt. A substitute Sequence Listing is filed electronically herewith, the contents of which are incorporated by reference in their entirety. The electronic file was created on Mar. 30, 2017, is 904 kilobytes in size, and titled 3122SEQ002.txt.

FIELD OF THE INVENTION

Provided herein are combinations of a hyaluronan-degrading enzyme, such as a hyaluronidase, and an immune checkpoint inhibitor. The combinations can be used in combination therapy to improve any therapy that includes administration of immune checkpoint inhibitors. The combination therapy can be used in methods of treating cancers, including solid and non-solid tumors.

BACKGROUND

Hyaluronan-degrading enzymes, such as PH20, are used in methods of treating hyaluronan-associated diseases or conditions, including cancers and in particular hyaluronan-associated cancers or tumors. Hyaluronan (hyaluronic acid; HA) is a glycosaminoglycan that exists predominantly in connective tissues, skin, cartilage, and in synovial fluid in mammals. In connective tissue, the water of hydration associated with hyaluronan creates hydrated matrices between tissues. HA is found in the extracellular matrix of many cells, especially in soft connective tissues. Certain diseases are associated with expression and/or production of hyaluronan, including solid tumors. Hyaluronidases are enzymes that degrade hyaluronan. By catalyzing the breakdown of HA, hyaluronidases can be used to treat diseases or disorders associated with accumulation of HA or other glycosaminoglycans, including cancers and tumors. For the treatment of cancers, and in particular solid tumor cancers, there is a need for improved or alternative therapeutic treatments.

SUMMARY

Provided are methods, combinations and uses thereof for treating cancers. The combinations and combination therapy include a first composition comprising a hyaluronan-degrading enzyme or hyaluronan synthesis inhibitor; and a second composition comprising an immune checkpoint inhibitor or other inhibitor of immune suppression. The compositions can be administered separately or together or sequentially or intermittently. The compositions can be formulated as a single composition. The cancers include solid tumors and also non-solid tumors, such as hematological cancers. As is known to those of skill in the art, cancers can be immunosuppressive. Treatment modalities have been developed that reverse or inhibit or decrease the immunosuppressive effects of cancers to thereby enhance or restore the immune response against tumors and tumor cells. The combinations, uses and methods herein combine these treatments with agents that reduce the amount of hyaluronan associated with tumors and tumor cells. Such agents include hyaluronan-degrading enzymes and hyaluronan synthesis inhibitors. The hyaluronan-degrading enzymes are formulated or modified or produced so that they have sufficient serum half-life to effect treatment.

Provided herein are combinations, uses of the combinations and methods for treating cancer and any other disorder treated with immune checkpoint inhibitors. The combinations contain a first agent that decreases the amount of hyaluronan present in tumor/cancer cells and a second agent that mitigates the immunosuppressive cancer microenvironment, such as indoleamine 2,3-dioxygenase (IDO) inhibitors and other inhibitors of immune suppressive enzymes and immune suppressive factors, inhibitors of T cell checkpoints (immune checkpoint inhibitors), agonists of selected TNF receptor family members, and inhibitors of undesirable cytokines. Thus, the combinations can include, for example, an inhibitor of hyaluronan (HA), such as a 4-methylumbelliferone (4-MU) (see, e.g., Edward et al., (2010) *British Journal of Dermatology* 162:1224-1232), or a hyaluronan-degrading enzyme, such as a hyaluronidase, and an immune checkpoint inhibitor. The first and second agent can be in separate compositions or formulated in the same composition; the first and second agent can be administered simultaneously, sequentially, intermittently or in any order.

In particular embodiments, provided are combinations for use in combination therapy of cancers including solid and other tumors. The combinations contain a first composition containing a hyaluronan-degrading enzyme, such as a hyaluronidase, that is conjugated to a polymer or formulated or provided in a manner that increases the serum half-life thereof, and a second composition containing an immune checkpoint inhibitor. The compositions can be formulated together, but typically are provided separately and administered separately. They can be administered sequentially or intermittently or simultaneously or in any order. The hyaluronan-degrading enzyme (or HA synthesis inhibitor), such as a hyaluronidase, (or HA synthesis inhibitor) is administered sequentially, before or after the checkpoint inhibitor, such as before the checkpoint inhibitor. In such embodiments, generally the hyaluronan-degrading enzyme, such as a hyaluronidase, is administered less than 1 or 2 days before, such as 48 hours or fewer, such as less than 40, 35, 30, 25, 24, 20, 18, 15, 12, 10, 8, 5 or fewer hours before the checkpoint inhibitor. Exemplary of checkpoint inhibitors are molecules that inhibit programmed death-ligand 1 (PD-L1), programmed cell death protein 1 (PD-1) or cytotoxic T-lymphocyte-associated protein 4 (CTLA4; also known as CD152), such as antibodies thereto, including antigen binding fragments thereof, and other inhibitors that mitigate the immunosuppressive tumor environment, such as inhibitors of immune suppressive enzymes, such as indoleamine 2,3-dioxygenase inhibitors (IDOI; see, e.g., Melief et al., (2015) *J Clin Invest.* 27:1-12). Inhibition of proteins and other factors that suppress the immune system prevents or decreases down regulation of the immune system, so that the immune system continues to recognize and attack tumor cells.

It is shown herein, for example, that administration of a hyaluronan-degrading enzyme, such as a soluble hyaluronidase, or a hyaluronan synthesis inhibitor, and an immune checkpoint inhibitor, can increase the response of a tumor cell or cancer cell to treatment with the inhibitor. For example, in one exemplary embodiment, administration of a hyaluronan-degrading enzyme or inhibitor of hyaluronan synthesis, prior to administration of an inhibitor of CTLA4 or PD-L1 improves treatment of tumors compared to the inhibitor alone.

Provided herein are methods for treating cancers, including solid tumors and other cancers, and uses of the combinations of the hyaluronan-degrading enzyme, such as a soluble hyaluronidase, and checkpoint inhibitors for treatment of the cancers. To effect treatment or use the compositions in the combinations, the methods and uses include administering a first composition containing a hyaluronan-degrading enzyme, particularly a hyaluronan-degrading enzyme conjugated to a polymer, followed by administering a second composition containing an immune checkpoint inhibitor. In any of such methods and uses, the hyaluronan-degrading enzyme composition and the immune checkpoint inhibitor composition can be administered either by the same route of administration or by different routes of administration. In some methods the hyaluronan-degrading enzyme composition and the immune checkpoint inhibitor composition are administered by the same route of administration. In any of the provided methods and uses, the hyaluronan-degrading enzyme composition and the immune checkpoint inhibitor composition can be administered systemically, for example by intravenous administration.

In certain embodiments of the methods and uses, the composition containing the hyaluronan-degrading enzyme is administered prior to administration of the checkpoint inhibitor. In such methods, the immune checkpoint inhibitor can be administered within 48 hours of administration of the hyaluronan-degrading enzyme, such as within at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours of administration of the hyaluronan-degrading enzyme. In some methods and uses, the hyaluronan-degrading enzyme is administered 6 hours to 30 hours or 12 hours to 24 hours, each inclusive, prior to administration of the immune checkpoint inhibitor. The timing and order of administration can be empirically determined, if necessary, for particular immune checkpoint inhibitors.

Any of the provided methods can be used to treat a cancer that is a tumor, such as a tumor that is a solid tumor. In some examples, the tumor is characterized as having a moderate to high hyaluronan content, such as a high hyaluronan content. Exemplary cancers that can be treated by the provided methods include, but are not limited to, pancreatic cancer, breast cancer, prostate cancer, bladder cancer, gastric cancer, mesothelioma, non-small cell lung cancer (NSCLC), and colon cancer.

The hyaluronan-degrading enzymes used in the provided methods and uses can be soluble hyaluronidases, which are formulated or modified to increase serum half-life. For example, the hyaluronidase can be a soluble PH20, such as ovine or bovine PH20 or a C-terminal truncated form of human PH20 that lacks a C-terminal glycosylphosphatidylinositol (GPI) attachment site or a portion of the GPI attachment site, whereby the truncated form exhibits hyaluronidase activity and is soluble. Included among human PH20 hyaluronan-degrading enzymes are enzymes that are soluble, retain hyaluronidase activity, and have a contiguous sequence of amino acids in SEQ ID NO: 217 that contains amino acid residues 36-464 of SEQ ID NO: 217, and residues up to a C-terminal amino acid residue, whereby the polypeptide is C-terminally truncated so that it does not include the full-length of the polypeptide whose sequence is set forth as amino acids 1-509 or 36-509 of SEQ ID NO: 217 or have a sequence of amino acids that has at least about 85% sequence identity thereto. In some examples, PH20 has a sequence of amino acids that has at least about 86%, 87%, 88%, 89%, 90%, 91%, 92%, 93%, 94%, 95%, 96%, 97%, 98% or 99% sequence identity to a polypeptide that has a contiguous sequence of amino acids in SEQ ID NO: 217 that contains amino acid residues 36-464 of SEQ ID NO: 217, and residues up to a C-terminal amino acid residue, whereby the polypeptide is C-terminally truncated so that it does not include the full-length of the polypeptide whose sequence is set forth as amino acids 1-509 or 36-509 of SEQ ID NO: 217, that is soluble and retains hyaluronidase activity. Exemplary PH20 polypeptides have the sequence of amino acids set forth in any of SEQ ID NOS: 123-158, or a sequence of amino acids that exhibits at least 85%, such as at least about 86%, 87%, 88%, 89%, 90%, 91%, 92%, 93%, 94%, 95%, 96%, 97%, 98% or 99% sequence identity thereto and retains hyaluronidase activity.

The hyaluronan-degrading enzyme for the methods and uses herein is modified by a polymer. In some examples, the polymer is a polyalkylene glycol, dextran, pullulan or cellulose. Polyalkylene glycol polymers, which can modify the hyaluronan-degrading enzyme include polyethylene glycol (PEG) and methoxypolyethylene glycol (mPEG). In examples where the hyaluroanan-degrading enzyme is modified by PEG, the PEG can by branched or linear. In any of the examples, the polymer can be produced by reaction with methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol))$_2$-N-hydroxysuccinimide ester (mPEG$_2$-NHS) (10 kDa branched); (methoxy-poly(ethylene glycol))$_2$-N-hydroxysuccinimide ester (mPEG$_2$-NHS) (20 kDa branched); (methoxy-poly(ethylene glycol))$_2$-N-hydroxysuccinimide ester (mPEG$_2$-NHS) (40 kDa branched); (methoxy-poly(ethylene glycol))$_2$-N-hydroxysuccinimide ester (mPEG$_2$-NHS) (60 kDa branched); biotin-poly(ethylene glycol)-N-hydroxysuccinimide ester (biotin-PEG-NHS) (5 kDa biotinylated); poly(ethylene glycol)-p-nitrophenyl carbonate (PEG-p-nitrophenyl-carbonate) (30 kDa); or poly(ethylene glycol)-propionaldehyde (PEG-propionaldehyde) (30 kDa).

In any of the examples, the polymer can be a PEG that has a molecular weight of 30 or about 30 kilodaltons.

In any of the methods of treating cancer provided herein, the hyaluronan-degrading enzyme can be administered in a dosage range amount of between or about between 0.01 µg/kg to 100 µg/kg (body weight (BW) of the subject), 0.01 µg/kg to 50 µg/kg, 0.01 µg/kg to 15 µg/kg, 0.05 µg/kg to 10 µg/kg, 0.75 µg/kg to 7.5 µg/kg, 1.0 µg/kg to 5.0 or 1.0 µg/kg to 3.0 µg/kg or in a dosage range amount of between or about between 0.1 to 5,000 Units/kg BW of the subject, 0.5 to 4,000 Units/kg, 1 to 1,000 Units/kg, 1 to 500 Units/kg, 5 to 500 Units/kg, 10 to 500 Units/kg or 20 to 400 Units/kg body weight (BW) of the subject.

Alternatively, the above-described hyaluronan-degrading enzymes can be formulated for sustained release, such as in lipid vesicles, including liposomes and other such vehicles. The vesicles can be targeted for delivery to selected cells, such as lymphocytes and/or tumor cells, depending upon the checkpoint inhibitor used in combination therewith. The checkpoint inhibitor can be formulated with the hyaluronan-degrading enzyme. The hyaluronan-degrading enzyme, such as a soluble hyaluronidase, as described herein, can be encoded in a vector, such as an oncolytic vector for delivery to tumors and expression therein or targeted for delivery to other cells and tissues; the checkpoint inhibitor, if a protein, also can be encoded in the vector for expression.

In any of the uses and methods of treating cancer provided herein, the administered immune checkpoint inhibitor blocks activity of an immune checkpoint protein. Non-limiting examples of immune checkpoint proteins include CTLA4, PD-1, and PD-L1. The immune checkpoint inhibitor can be an antibody, a fusion protein, an aptamer, a small molecule inhibitor, or an immune checkpoint protein-binding fragment thereof or other inhibitors that mitigate the immunosuppressive effect/environment of cancers, such as IDO inhibitors (IDOI). In any of the provided methods, the immune checkpoint inhibitor can be an anti-immune checkpoint protein antibody or antigen-binding fragment thereof or a small molecule inhibitor. Such inhibitors are known to those of skill in the art.

Another exemplary anti-immune checkpoint protein antibody is an anti-PD-L1 antibody, derivatives thereof, and antigen-binding fragments thereof. Exemplary PD-L1 antibodies include BMS-936559, derivatives thereof, and antigen-binding fragments thereof, that have a heavy chain variable domain that has the sequence of amino acids set forth in SEQ ID NO: 92 and a light chain variable domain that has the sequence of amino acids set forth in SEQ ID NO: 94, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 92 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 94.

Exemplary anti-PD-L1 antibodies also include MEDI4736, derivatives thereof, and an antigen-binding fragments thereof, that have a heavy chain variable domain that has the sequence of amino acids set forth in SEQ ID NO: 102 and a light chain variable domain that has the sequence of amino acids set forth in SEQ ID NO: 104, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 102 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 104; and Exemplary PD-L1 antibodies also include MPDL3280A, derivatives thereof, and antigen-binding fragments thereof, that have a heavy chain variable domain that has the sequence of amino acids set forth in SEQ ID NO: 114 and a light chain variable domain that has the sequence of amino acids set forth in SEQ ID NO: 115, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 114 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 115.

An exemplary anti-immune checkpoint protein antibody is an anti-CTLA4 antibody, derivatives thereof, and antigen-binding fragments thereof. Exemplary anti-CTLA4 antibodies include, for example, Ipilimumab, derivatives thereof, and an antigen-binding fragments thereof, that have a heavy chain variable domain with a sequence of amino acids set forth in SEQ ID NO: 22 and a light chain variable domain with a sequence of amino acids set forth in SEQ ID NO: 24; or a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 22 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 24.

Exemplary anti-CTLA4 antibodies also include Tremelimumab, derivatives thereof, and antigen-binding fragments thereof, that have a heavy chain variable domain with a sequence of amino acids set forth in SEQ ID NO: 34 and a light chain variable domain with a sequence of amino acids set forth in SEQ ID NO: 36 or a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 34 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 36.

Another exemplary anti-immune checkpoint protein antibody is an anti-PD-1 antibody, derivatives thereof, and antigen-binding fragments thereof. Exemplary anti-PD-1 antibodies include Nivolumab, derivatives thereof, and an antigen-binding fragments thereof, that have a heavy chain variable domain with a sequence of amino acids set forth in SEQ ID NO: 54 and a light chain variable domain with a sequence of amino acids set forth in SEQ ID NO: 56 or a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 54 and a variable light chain consisting of a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 56.

Exemplary anti-PD-1 antibodies also include MK-3475, derivatives thereof, or antigen-binding fragments thereof, that have a heavy chain variable domain with a sequence of amino acids set forth in SEQ ID NO: 68 and a light chain variable domain with a sequence of amino acids set forth in SEQ ID NO: 70, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 68 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 70.

Exemplary anti-PD-1 antibodies also include Pidilizumab, derivatives thereof, and antigen-binding fragments thereof that have a heavy chain variable domain that has a sequence of amino acids set forth in SEQ ID NO: 82 and a light chain variable domain that has a sequence of amino acids set forth in SEQ ID NO: 84, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 82 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 84.

Dosage ranges for the immune checkpoint inhibitors and any other inhibitors of the immune suppressive effects of tumors can be those known to those of skill in the art or they can be empirically determined for combination therapy. By virtue of any increase in effectiveness of the immune checkpoint inhibitors and other inhibitors of immune suppression, the dosage can be lower. Similarly dosages of the hyaluronan-degrading enzyme and hyaluronan inhibitors can be those dosages known to those of skill in the art. Exemplary dosages in animal models are described in the examples. Those of skill in the art can extrapolate or predict human dosages from animal models (see, e.g., Huang et al. (2014) *The application of allometric scaling principles to predict pharmacokinetic parameters across species*, Expert Opin Drug Metab Toxico1.10:1241-53). For example, a human equivalent dosage of PEGPH20 used in the examples herein in the rodent model is 37.5 µg/kg. The human dosage is 3 µg/kg. Thus, in some embodiments, where the hyaluronan-degrading enzyme is PEGPH20, the dosage for human for administration with an immune checkpoint inhibitor, such as an anti-PD-L1 antibody, is or is about 1-10 µg/kg, such as 2-4 µg/kg, and particularly 3 µg/kg. It is understood that the dosage will depend upon the subject, the treatment regimen, the particular agent, the amount of side-effects tolerated, additional agents administered that counter the side effects and other such parameters. The skilled person in view of the disclosure herein can select appropriate dosages of each agent.

For example, in any of the provided methods, the immune checkpoint inhibitor can be administered in a dosage range that is between or between about 0.1 mg per kg body weight (mg/kg BW) to about 50 mg/kg BW, about 0.1 mg/kg to about 20 mg/kg BW, about 0.1 to about 10 mg/kg BW, about 0.3 to about 10 mg/kg BW, about 0.5 mg/kg to 5 mg/kg BW or 0.5 mg/kg to 1 mg/kg BW. Exemplary doses of an immune checkpoint inhibitor for use in any of the provided methods include a dosage that is at least or is at least about 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg·kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 21 mg/kg, 22 mg/kg, 23 mg/kg, 24 mg/kg, 25 mg/kg, 30 mg/kg, 40 mg/kg, or 50 mg/kg body weight (BW) of the subject to be treated.

In any of the methods of combination treatment provided herein, the hyaluronan-degrading enzyme or hyaluronan synthesis inhibitor can be administered at any suitable frequency, such as, for example, frequency of once a day, every other day, twice weekly, once weekly, once every 2 weeks, once every 3 weeks or once every 4 weeks; and the immune checkpoint inhibitor can be administered at the same frequency as the hyaluronan-degrading enzyme or at a different frequency, wherein each administration of the immune checkpoint inhibitor is preceded by an administration of hyaluronan-degrading enzyme by not more than 48 hours. For example, the immune checkpoint inhibitor can be administered twice weekly, once weekly, once every 2 weeks, once every 3 weeks, once every 4 weeks, once every 6 weeks, once every 2 months, once every 3 months, once every 4 months, once every 5 months, or once every 6 months; wherein each administration of the immune checkpoint inhibitor is preceded by an administration of hyaluronan-degrading enzyme by not more than 48 hours.

An exemplary dosage regimen which can be employed by any of the methods provided herein involves administration of the hyaluronan-degrading enzyme twice weekly, while the immune checkpoint inhibitor is administered no more than once a week, where each administration of the immune checkpoint inhibitor is preceded by an administration of hyaluronan-degrading enzyme by not more than 48 hours. For example, the immune checkpoint inhibition can be administered no more than once every three weeks or once every four weeks, while the hyaluronan-degrading enzyme is administered twice weekly. In other examples, the hyaluronan-degrading enzyme is administered twice weekly and the immune checkpoint inhibitor is administered twice weekly, wherein each administration of the immune checkpoint inhibitor is preceded by an administration of hyaluronan-degrading enzyme by not more than 48 hours. In some examples, each administration of the immune checkpoint inhibitor is preceded by an administration of the hyaluronan-degrading enzyme by not more than 24 hours.

Also provided herein are methods of a hyaluronan-degrading enzyme and immune checkpoint inhibitor combination therapy for treating a cancer that further include administering a corticosteroid, such as a glucocorticoid. The glucocorticoid can be selected from among cortisones, dexamethasones, hydrocortisones, methylprednisolones, prednisolones and prednisones. In any of the provided methods, the corticosteroid can be administered prior to, concurrent with, intermittently with or subsequent to administration of the hyaluronan-degrading enzyme. In some examples, the corticosteroid is administered prior to administration of the hyaluronan-degrading enzyme and subsequent to administration of the hyaluronan-degrading enzyme. In other examples, the corticosteroid is co-administered with the hyaluronan-degrading enzyme. In some examples the corticosteroid, such as a glucocorticoid, can be administered, for example, at least or about at least 1 hour prior to administration of the hyaluronan-degrading enzyme, or at least 8 hours to 12 hours after administration of the anti-hyaluronan agent. In any of the provided methods and combinations, the corticosteroid can be administered in an amount that is between at or about 0.1 to 20 mg, 0.1 to 15 mg, 0.1 to 10 mg, 0.1 to 5 mg, 0.2 to 20 mg, 0.2 to 15 mg, 0.2 to 10 mg, 0.2 to 5 mg, 0.4 to 20 mg, 0.4 to 15 mg, 0.4 to 10 mg, 0.4 to 5 mg, 0.4 to 4 mg, 1 to 20 mg, 1 to 15 mg or 1 to 10 mg. In any of the provided methods, the corticosteroid can be administered orally.

Also provided herein are combinations that include a first composition containing a hyaluronan-degrading enzyme formulated or modified to have increased serum half-life compared to the hyaluronan-degrading enzyme alone or containing a hyaluronan synthesis inhibitor (or mixtures thereof); and a second composition containing an immune checkpoint inhibitor or other inhibitor of immune suppression. The combinations include any described as used in the methods provided herein. The hyaluronan-degrading enzyme can be polymer conjugated or can be formulated for extended release such as in or associated with a vesicle, such as a liposome or micelle or multilaminer vesicle or multivesicular vesicle, or encoded in a vector, such as a gene therapy vector or oncolytic vector for delivery to a tumor cell.

Provided herein are combinations that include a first composition containing a polymer-conjugated hyaluronan-degrading enzyme and a second composition containing an immune checkpoint inhibitor. In any of the provided combinations, the hyaluronan-degrading enzyme can be a hyaluronidase, such as a PH20 or truncated form thereof that lacks a C-terminal glycosylphosphatidylinositol (GPI) attachment site or a portion of the GPI attachment site. In any of the provided combinations, the hyaluronan-degrading enzyme can be a human or non-human PH20. Included among human PH20 hyaluronan-degrading enzymes are enzymes that are soluble, retain hyaluronidase activity, and have a contiguous sequence of amino acids in SEQ ID NO: 217 that contains amino acid residues 36-464 of SEQ ID NO: 217, and residues up to a C-terminal amino acid residue, whereby the polypeptide is C-terminally truncated so that it does not include the full-length of the polypeptide whose sequence is set forth as amino acids 1-509 or 36-509 of SEQ ID NO: 217 or have a sequence of amino acids that has at least about 85% sequence identity thereto. In some examples, PH20 has a sequence of amino acids that has at least about 86%, 87%, 88%, 89%, 90%, 91%, 92%, 93%, 94%, 95%, 96%, 97%, 98% or 99% sequence identity to a polypeptide that has and have a contiguous sequence of amino acids in SEQ ID NO: 217 that contains amino acid residues 36-464 of SEQ ID NO: 217, and residues up to a C-terminal amino acid residue, whereby the polypeptide is C-terminally truncated so that it does not include the full-length of the polypeptide whose sequence is set forth as amino acids 1-509 or 36-509 of SEQ ID NO: 217, that is soluble and retains hyaluronidase activity. Exemplary PH20 polypeptides have the sequence of amino acids set forth in any of SEQ ID NOS: 123-158, or a sequence of amino acids that exhibits at least 85%, such as at least about 86%, 87%, 88%, 89%, 90%, 91%, 92%, 93%, 94%, 95%, 96%, 97%, 98% or 99% sequence identity thereto and retains hyaluronidase activity.

The hyaluronan-degrading enzyme provided in the combinations herein is modified by a polymer. In some examples, the polymer is a polyalkylene glycol, dextran, pullulan or cellulose. Polyalkylene glycol polymers, which can modify the hyaluronan-degrading enzyme include polyethylene glycol (PEG) and methoxypolyethylene glycol (mPEG). In examples where the hyaluroanan-degrading enzyme is modified by PEG; the PEG can by branched or linear. In any of the examples, the polymer can be produced by reaction with methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol))$_2$-N-hydroxysuccinimide ester (mPEG$_2$-NHS) (10 kDa branched); (methoxy-poly(ethylene glycol))$_2$-N-hydroxysuccinimide ester (mPEG$_2$-NHS) (20 kDa branched); (methoxy-poly(ethylene glycol))$_2$-N-hydroxysuccinimide ester (mPEG$_2$-NHS) (40 kDa branched); (methoxy-poly(ethylene glycol))$_2$-N-hydroxysuccinimide ester (mPEG$_2$-NHS) (60 kDa branched); biotin-poly(ethylene glycol)-N-hydroxysuccinimide ester (biotin-PEG-NHS) (5 kDa biotinylated); poly(ethylene glycol)-p-nitrophenyl carbonate (PEG-p-nitrophenyl-carbonate) (30 kDa); or poly(ethylene glycol)-propionaldehyde (PEG-propionaldehyde) (30 kDa). In any of the examples, the polymer can be a PEG that has a molecular weight of 30 or about 30 kilodaltons.

The polymer-conjugated hyaluronan-degrading enzyme composition, in any of the combinations provided herein, can contain an amount of hyaluronan-degrading enzyme that is in an amount within the range of between or between about 0.1 µg/mL to 100 µg/mL, 1 µg/mL to 50 µg/mL or 1 µg/mL to 20 µg/mL hyaluronan-degrading enzyme conjugated to a polymer or an amount of hyaluronan-degrading enzyme within the range of between or about between 10 U/mL to 5000 U/mL, 50 U/mL to 4000 U/mL, 100 U/mL to 2000 U/mL, 300 U/mL to 2000 U/mL, 600 U/mL to 2000 U/mL, or 100 U/mL to 1000 U/mL hyaluronan-degrading enzyme conjugated to a polymer. Non-limiting volumes of the hyaluronan-degrading enzyme composition in the provided method include ranges from or from about 0.5 mL to 50 mL, 1 mL to 10 mL, or 1 mL to 5 mL.

The provided combinations also include a composition containing an immune checkpoint inhibitor. The target of the immune checkpoint inhibitor is an immune checkpoint protein. Exemplary targets of the immune checkpoint inhibitor, in the provided compositions, include, but are not limited to CTLA4, PD-1, and PD-L1. In any of the provided combinations, the immune checkpoint protein inhibitor can be an antibody, a fusion protein, an aptamer, or an immune checkpoint protein-binding fragment of an antibody, fusion protein or aptamer. The immune checkpoint protein inhibitor, in the provided combinations can be an anti-immune checkpoint protein antibody or antigen-binding fragment thereof.

An exemplary anti-immune checkpoint protein antibody, in the provided combinations, is an anti-CTLA4 antibody, derivatives thereof, and antigen-binding fragments thereof. Exemplary anti-CTLA4 antibodies include Ipilimumab, derivatives thereof, and antigen-binding fragments thereof, that have a heavy chain with a sequence of amino acids set forth in SEQ ID NO: 22 and a light chain variable domain with a sequence of amino acids set forth in SEQ ID NO: 24; or a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 22 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 24.

Exemplary anti-CTLA4 antibodies, in the provided combinations, also include Tremelimumab, derivatives thereof, and antigen-binding fragments thereof, that have a heavy chain variable domain with a sequence of amino acids set forth in SEQ ID NO: 34 and a light chain with a sequence of amino acids set forth in SEQ ID NO: 36 or a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 34 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 36.

Another exemplary anti-immune checkpoint protein antibody, in the provided combinations, is an anti-PD-1 antibody, derivatives thereof, and antigen-binding fragments thereof. Exemplary PD-1 antibodies include Nivolumab, derivatives thereof, and antigen-binding fragments thereof, that have a heavy chain variable domain with a sequence of amino acids set forth in SEQ ID NO: 54 and a light chain with a sequence of amino acids set forth in SEQ ID NO: 56 or a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 54 and a variable light chain consisting of a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 56.

Exemplary anti-PD-1 antibodies, in the provided combinations, also include MK-3475, derivatives thereof, or antigen-binding fragments thereof, that have a heavy chain variable domain with a sequence of amino acids set forth in SEQ ID NO: 68 and a light chain variable domain with a sequence of amino acids set forth in SEQ ID NO: 70, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 68 and a variable light chain that has a sequence identity of at least 85%, 86%, 8'7%, 88%, 89%, 90%, 91%, 92%, 93%, 94%, 95%, 96%, 97%, 98%, or 99% to the light chain set forth in SEQ ID NO: 70.

Exemplary anti-PD-1 antibodies, in the provided combinations, also include Pidilizumab, derivatives thereof, and antigen-binding fragments thereof that have a heavy chain variable domain that has a sequence of amino acids set forth in SEQ ID NO: 82 and a light chain variable domain that has a sequence of amino acids set forth in SEQ ID NO: 84, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 82 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 84.

Another exemplary anti-immune checkpoint protein antibody is an anti-PD-L1 antibody, derivatives thereof, and antigen-binding fragments thereof. Exemplary PD-L1 antibodies include BMS-936559, derivatives thereof, and antigen-binding fragments thereof, that have a heavy chain variable domain that has the sequence of amino acids set forth in SEQ ID NO: 92 and a light chain variable domain that has the sequence of amino acids set forth in SEQ ID NO: 94, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 92 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 94.

Exemplary anti-PD-L1 antibodies, in the provided combinations, also include MEDI4736, derivatives thereof, and antigen-binding fragments thereof, comprising that have a heavy chain variable domain that has the sequence of amino acids set forth in SEQ ID NO: 102 and a light chain variable domain that has the sequence of amino acids set forth in SEQ ID NO: 104, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 102 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 104.

Exemplary anti-PD-L1 antibodies, in the provided combinations, also include MPDL3280A, derivatives thereof, and antigen-binding fragments thereof, that have a heavy chain variable domain that has the sequence of amino acids set forth in SEQ ID NO: 114 and a light chain variable domain that has the sequence of amino acids set forth in SEQ ID NO: 115, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 114 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 115.

In any of the combinations provided herein, the immune checkpoint inhibitor in the composition can be provided in an amount that is selected from between or about between 0.5 mg/mL to 50 mg/mL, 1 mg/mL to 10 mg/mL or 2 mg/mL to 6 mg/mL. The immune checkpoint inhibitor also can be provided in the combination in an amount that is at least or about at least 0.5 mg/mL, 1 mg/mL, 2 mg/mL, 3 mg/mL, 4 mg/mL, 5 mg/mL, 6 mg/mL, 7 mg/mL, 8 mg/mL, 9 mg/mL or 10 mg/mL. The composition containing the immune checkpoint inhibitor can be provided in a volume that is from or from about 0.5 mL to 500 mL, 1 mL to 50 mL, or 10 mL to 40 mL. In some examples, the immune checkpoint inhibitor composition is provided in a volume of at least or at least about 1 mL, 5 mL, 10 mL, 20 mL, 30 mL, 40 mL, 50 mL, 60 mL, 70 mL, 80 mL, 90 mL or 100 mL.

Any of the combinations provided herein can further contain a corticosteroid in addition to the polymer-conjugated hyaluronan-degrading enzyme and immune checkpoint inhibitor compositions. An exemplary corticosteroid that can be included in the provided combinations includes a glucocorticoid. Exemplary glucocorticoids include, but are not limited to, cortisones, dexamethasones, hydrocortisones, methylprednisolones, prednisolones and prednisones.

Also provided herein are combinations, such as pharmaceutical combinations, for use in treating a cancer and uses of combinations for treating a cancer. For example, provided herein are combinations for use in treating a cancer in an animal, wherein the animal is first exposed to the hyaluronan-degrading enzyme conjugated to a polymer and then contacted with the immune checkpoint inhibitor. Also provided are uses of any of the provided combinations for the preparation of a medicament to treat cancer in an animal, wherein the immune checkpoint inhibitor and hyaluronan-degrading enzyme each are in a pharmaceutically acceptable form, and the animal, such as a human, is exposed to the hyaluronan-degrading enzyme conjugated to a polymer or other form of hyaluronan-degrading enzyme that has increased serum half-life, and also contacted with the immune checkpoint inhibitor. The hyaluronan-degrading enzyme, such as a soluble hyaluronidase, can be administered with the checkpoint inhibitor, before the checkpoint inhibitor, intermittently therewith or sequentially. In some embodiments, the animal, such as a human, is first exposed to the hyaluronan-degrading enzyme conjugated to a polymer and then contacted with the immune checkpoint inhibitor.

In any of the provided combinations or uses the hyaluronan-degrading enzyme and immune checkpoint inhibitor can be formulated for administration by the same route of administration or by different routes of administration. In some examples of the provided combinations and uses, the hyaluronan-degrading enzyme and immune checkpoint inhibitor are administered by the same route of administration. For example, in any of the provided combinations or uses, the hyaluronan-degrading enzyme and immune checkpoint inhibitor are formulated for oral, intravenous (IV), subcutaneous, intramuscular, intra-tumoral, intradermal, topical, transdermal, rectal, intrathecal or sub-epidermal administration. In particular examples, the hyaluronan-degrading enzyme and immune checkpoint inhibitor are formulated for systemic administration, such as intravenous administration.

In any of the provided combinations or uses, the hyaluronan-degrading enzyme can be exposed to the animal up to 48 hours before the immune checkpoint inhibitor is exposed to the animal, such as at least or at least about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours, or 48 hours before the immune checkpoint inhibitor is exposed to the animal, whereby the hyaluronan-degrading enzyme is formulated for administration at least 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours, or 48 hours prior to the immune checkpoint inhibitor.

Any of the combinations or uses for treating a cancer provided herein can be for treating a cancer that is a tumor, such as solid tumor. The methods also can be used for treating other cancers in which hyaluronan plays a role. For example, hyaluronan (HA), an important component of cancer progression, is synthesized by hyaluronan synthases (HASs). In cancer cells, hyaluronan synthase 1 (HAS1) pre-mRNA is abnormally spliced to generate a family of aberrant splice variants (HAS1Vs), which almost exclusively occur in malignant cells, and which synthesize extracellular and intracellular HA. Expression of aberrant HAS1Vs predicts poor survival, for example, in multiple myeloma (see e.g., Adamia et al. (2014) *Adv. Cancer Res.* 123:67-94). Extracellular HA can participate in malignant spread; and intracellular HA can play a role in oncogenesis (see e.g., Adamia et al. (2014) *Adv. Cancer Res.* 123:67-94). In particular examples the tumor is characterized as having a moderate to high hyaluronan content, such as a high hyaluronan content. Non-limiting examples of cancers to be treated by the combinations and uses provided herein include pancreatic cancer, breast cancer, prostate cancer, bladder cancer, gastric cancer, mesothelioma, NSCLC, and colon cancer.

Also provided herein are immune checkpoint inhibitors for use in treating a cancer in a subject, and uses of an immune checkpoint inhibitor for treating a cancer in a subject, wherein the subject has been treated with a hyaluronan-degrading enzyme, and the hyaluronan-degrading enzyme is conjugated to a polymer. In such immune checkpoint inhibitors or uses, the immune checkpoint inhibitor can block activity of an immune checkpoint protein. Exemplary targets of the immune checkpoint inhibitor, for the provided immune checkpoint inhibitors and uses, include, but are not limited to CTLA4, PD-1, and PD-L1. The provided immune checkpoint inhibitors and uses for treating cancer include immune checkpoint protein inhibitors selected from among antibodies, fusion proteins, aptamers, and immune checkpoint protein-binding fragments thereof. In particular examples, the provided immune checkpoint protein inhibitor or use includes an immune checkpoint inhibitor that is an anti-immune checkpoint protein antibody or antigen-binding fragment thereof.

The provided immune checkpoint inhibitors and uses include an anti-immune checkpoint protein antibody that is an anti-CTLA4 antibody, a derivative thereof, or antigen-binding fragment thereof. Exemplary anti-CTLA4 antibodies include Ipilimumab, derivatives thereof, and antigen-binding fragments thereof, that have a heavy chain variable domain with a sequence of amino acids set forth in SEQ ID NO: 22 and a light chain variable domain with a sequence of amino acids set forth in SEQ ID NO: 24; or a variable heavy chain that has a sequence of amino acids that has a sequence identity of at least 85%, 86%, 8'7%, 88%, 89%, 90%, 91%, 92%, 93%, 94%, 95%, 96%, 97%, 98%, or 99% to the heavy chain set forth in SEQ ID NO: 22 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 24.

Exemplary anti-CTLA4 antibodies also include Tremelimumab, derivatives thereof, and antigen-binding fragments thereof, that have a heavy chain variable domain with a sequence of amino acids set forth in SEQ ID NO: 34 and a light chain variable domain with a sequence of amino acids set forth in SEQ ID NO: 36 or a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 34 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 36.

The provided immune checkpoint inhibitors and uses also include an anti-immune checkpoint protein antibody that is an anti-PD-L1 antibody, a derivative thereof, or antigen-binding fragment thereof. Exemplary PD-L1 antibodies include BMS-936559, derivatives thereof, and antigen-binding fragments thereof, that have a heavy chain variable domain that has the sequence of amino acids set forth in SEQ ID NO: 92 and a light chain variable domain that has the sequence of amino acids set forth in SEQ ID NO: 94, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 92 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 94.

Exemplary PD-L1 antibodies also include MEDI4736, derivatives thereof, and antigen-binding fragments thereof, that have a heavy chain variable domain that has the sequence of amino acids set forth in SEQ ID NO: 102 and a light chain variable domain that has the sequence of amino acids set forth in SEQ ID NO: 104, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 102 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 104.

Exemplary PD-L1 antibodies also include MPDL3280A, derivatives thereof, and antigen-binding fragments thereof, that have a heavy chain variable domain that has the sequence of amino acids set forth in SEQ ID NO: 114 and a light chain variable domain that has the sequence of amino acids set forth in SEQ ID NO: 115, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 114 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 115.

The provided immune checkpoint inhibitors and uses also include an anti-immune checkpoint protein antibody that is an anti-PD-1 antibody, a derivative thereof, or antigen-binding fragment thereof. Exemplary anti-PD-1 antibodies include Nivolumab, derivatives thereof, and antigen-binding fragments thereof, that have a heavy chain variable domain with a sequence of amino acids set forth in SEQ ID NO: 54 and a light chain variable domain with a sequence of amino acids set forth in SEQ ID NO: 56 or a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 54 and a variable light chain consisting of a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 56.

Exemplary anti-PD-1 antibodies also include MK-3475, derivatives thereof, or antigen-binding fragments thereof, that have a heavy chain variable domain with a sequence of amino acids set forth in SEQ ID NO: 68 and a light chain variable domain with a sequence of amino acids set forth in SEQ ID NO: 70, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 68 and a variable light chain that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 70.

Exemplary anti-PD-1 antibodies also include Pidilizumab, derivatives thereof, and antigen-binding fragments thereof that have a heavy chain variable domain that has a sequence of amino acids set forth in SEQ ID NO: 82 and a light chain variable domain that has a sequence of amino acids set forth in SEQ ID NO: 84, or a variable heavy chain that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 82 and a variable light chain that has a sequence identity of at least 85%, 86%, 87%, 88%, 89%, 90%, 91%, 92%, 93%, 94%, 95%, 96%, 97%, 98%, 99% to the light chain set forth in SEQ ID NO: 84.

The provided immune checkpoint inhibitors and uses include an immune checkpoint protein inhibitor that is formulated for administration at a concentration selected from among between or about between 0.5 mg/mL to 50 mg/mL, 1 mg/mL to 10 mg/mL or 2 mg/mL to 6 mg/mL; and at least 0.5 mg/mL, 1 mg/mL, 2 mg/mL, 3 mg/mL, 4 mg/mL, 5 mg/mL, 6 mg/mL, 7 mg/mL, 8 mg/mL, 9 mg/mL or 10 mg/mL. Such formulations can include the immune checkpoint inhibitor in a volume that is from or from about 0.5 mL to 500 mL, 1 mL to 50 mL, or 10 mL to 40 mL; or at least 1 mL, 5 mL, 10 mL, 20 mL, 30 mL, 40 mL, 50 mL, 60 mL, 70 mL, 80 mL, 90 mL or 100 mL.

In any of the provided immune checkpoint inhibitors and uses, the subject is exposed to a hyaluronan-degrading enzyme. The hyaluronan-degrading enzyme can be a hyaluronidase, such as a PH20 or truncated form thereof that lacks a C-terminal glycosylphosphatidylinositol (GPI) attachment site or a portion of the GPI attachment site. Such a PH20 can be a human or non-human PH20. For example, the hyaluronan-degrading enzyme can be a C-terminal truncated PH20 that has a contiguous sequence of amino acids in SEQ ID NO: 217 that contains amino acids 36-464 of SEQ ID NO: 217 and residues up to a C-terminal amino acid residue, whereby the polypeptide is C-terminally truncated so that it does not include the full-length of the polypeptide whose sequence is set forth as amino acids 1-509 or 36-509 of SEQ ID NO: 217 or a variant thereof that has at least 85% sequence identity thereto that is soluble and retains hyaluronidase activity. In some examples, the variant PH20 can have a sequence of amino acids that has at least 86%, 87%, 88%, 89%, 90%, 91%, 92%, 93%, 94%, 95%, 96%, 97%, 98% or 99% sequence identity to the sequence of amino acids in SEQ ID NO: 217 that contains amino acids 36-464 of SEQ ID NO: 217 and residues up to a C-terminal amino acid residue, whereby the polypeptide is C-terminally truncated so that it does not include the full-length of the polypeptide whose sequence is set forth as amino acids 1-509 or 36-509 of SEQ ID NO: 217, as long as it is soluble and retains hyaluronidase activity. Examples of such PH20 enzymes include any PH20 that has a sequence of amino acids set forth in any of SEQ ID NOS: 123-158, or a sequence of amino acids that exhibits at least 85% sequence identity, such as at least 86%, 87%, 88%, 89%, 90%, 91%, 92%, 93%, 94%, 95%, 96%, 97%, 98% or 99% sequence identity, to a sequence of amino acids set forth in any of SEQ ID NOS: 123-158 and retains hyaluronidase activity.

The provided immune checkpoint inhibitors and uses for treating cancer includes a polymer-conjugated hyaluronan-degrading enzyme. Non-limiting exemplary polymers which can be conjugated to the enzyme polyalkylene glycol, dextran, pullulan and cellulose. In some examples, the polymer is a polyalkylene glycol, selected from among polyethylene glycol (PEG) and methoxypolyethylene glycol (mPEG), wherein the PEG is a branched or linear PEG The polymer that is conjugated to the hyaluronan-degrading enzyme can be produced by reaction with methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol))$_2$-N-hydroxysuccinimide ester (mPEG$_2$-NHS) (10 kDa branched); (methoxy-poly(ethylene glycol))$_2$-N-hydroxysuccinimide ester (mPEG$_2$-NHS) (20 kDa branched); (methoxy-poly(ethylene glycol))$_2$-N-hydroxysuccinimide ester (mPEG$_2$-NHS) (40 kDa branched); (methoxy-poly(ethylene glycol))$_2$-N-hydroxysuccinimide ester (mPEG$_2$-NHS) (60 kDa branched); biotin-poly(ethylene glycol)-N-hydroxysuccinimide ester (biotin-PEG-NHS) (5 kDa biotinylated); poly(ethylene glycol)-p-nitrophenyl carbonate (PEG-p-nitrophenyl-carbonate) (30 kDa); or poly(ethylene glycol)-propionaldehyde (PEG-propionaldehyde) (30 kDa). In particular examples, the polymer is a PEG that has a molecular weight of 30 or about 30 kilodaltons.

The provided immune checkpoint inhibitor or use for treating cancer can be formulated for oral, intravenous (IV), subcutaneous, intramuscular, intra-tumoral, intradermal, topical, transdermal, rectal, intrathecal or sub-epidermal administration. In particular examples, the immune checkpoint inhibitor or use is formulated for systemic administration, such as intravenous administration. The provided immune checkpoint inhibitor can be formulated for use up to 48 hours after the subject is treated with the hyaluronan-degrading enzyme, such as at least or at least about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours, or 48 hours after the subject is treated with the hyaluronan-degrading enzyme.

The cancer treated by any of the provided immune checkpoint inhibitors or uses can be a tumor, such as a solid tumor. In particular examples, the tumor is characterized as having a moderate to high hyaluronan content, such as a high hyaluronan content. Exemplary cancers treated by the provided immune checkpoint inhibitors and use include, but are not limited to, pancreatic cancer, breast cancer, prostate cancer, bladder cancer, gastric cancer, mesothelioma, NSCLC, and colon cancer.

DETAILED DESCRIPTION

Outline
- A. Definitions
- B. Immune Checkpoint Inhibitor and Hyaluronan-Degrading Enzyme Combination Therapy
  - 1. Solid Tumors and Immune Response
  - 2. Immune Checkpoint Modulation of T-Cell Activity in Tumors
    - a. CTLA-4 and T-Cell Priming
    - b. PD-1 and T-Cell Effector Phase
    - c. Other Immunomodulatory Agents (e.g., LAG-3)
  - 3. Polymer-Conjugated Hyaluronan-Degrading Enzyme in Combination Therapy With An Immune Checkpoint Inhibitor
- C. Combination Therapy Agents
  - 1. Immune Checkpoint Inhibitors and Formulations Thereof
    - a. Anti-CTLA-4 Therapies
      - i. Ipilimumab and Derivatives Thereof
      - ii. Tremelimumab and Derivatives Thereof
    - b. Anti-PD-1 and Anti PD-1-L Therapies
      - i. Anti-PD-1 antibodies
        - (a) Nivolumab and Derivatives Thereof
        - (b) MK-3475 and Derivatives Thereof
        - (c) Pidilizumab and Derivatives Thereof
      - ii. Anti-PD-L1 antibodies
        - (a) BMS-936559 and Derivatives Thereof
        - (b) MPDL3280A and Derivatives Thereof
        - (c) MEDI4736 and Derivatives Thereof
    - c. Other Immunomodulatory Therapies
  - 2. Hyaluronan-Degrading Enzymes and Polymer-Conjugated Hyaluronan-Degrading Enzymes
    - a. Hyaluronidases
      - i. Mammalian-Type Hyaluronidases PH20
      - ii. Bacterial Hyaluronidase
      - iii. Hyaluronidases from Leeches, Other Parasites and Crustaceans
    - b. Other Hyaluronan-Degrading Enzymes
    - c. Soluble Hyaluronan-Degrading Enzymes (e.g., soluble PH20)
      - i. Soluble Human PH20
      - ii. rHuPH20
    - d. Glycosylation of Hyaluronan-Degrading Enzymes
    - e. Sustained or Controlled Release Formulations and Vectors Encoding Soluble Hyaluronidases
      - i. Modified (Polymer-Conjugated) Hyaluronan-Degrading Enzymes
        PEGylated Soluble Hyaluronan-Degrading Enzymes
      - ii. Sustained or Controlled Release Formulations and Vectors Encoding Soluble Hyaluronidases
        - a) Multivesicular Liposomes (MVL)
        - b) MVL Co-Formulations
- D. Methods of Producing Nucleic Acids and Encoded Polypeptides of Hyaluronan-Degrading Enzymes and Immune Checkpoint Inhibitors (e.g., Antibodies)
  - 1. Isolation or Preparation of Nucleic Acid Encoding Polypeptides
    - a. Hyaluronan-Degrading Enzyme
    - b. Immune Checkpoint Inhibitors (e.g., Antibodies)
  - 2. Vectors
  - 3. Cells and Expression
    - a. Prokaryotic Cells
    - b. Yeast Cells
    - c. Insect Cells
    - d. Mammalian cells
    - e. Plants
  - 4. Purification Techniques
  - 5. PEGylation of Hyaluronan-Degrading Enzyme Polypeptides
- E. Pharmaceutical Compositions and Formulations
  - 1. Formulations
    - a. Injectables, Solutions and Emulsions
    - b. Lyophilized Powders
    - c. Compositions for Other Routes of Administration
  - 2. Formulation Amounts
    - a. Hyaluronan-Degrading Enzyme Formulations
    - b. Checkpoint Inhibitor Formulations
  - 3. Packaging and Articles of Manufacture
- F. Methods of Monitoring and Assessing Activity, Bioavailability and Pharmacokinetics
  - 1. Hyaluronidase Activity
  - 2. Immune Checkpoint Inhibitor Activity
  - 3. Anticancer Activity of Combination Therapy
    - a. Tumor Growth and Volume
    - b. Presence of Tumor Markers
    - c. Immunological Monitoring
      - i. Frequency of Specific Cell Types in Peripheral Blood
      - ii. Detecting Immune Cell Markers
      - iii. Antigen-Specific Immune Responses
  - 4. Pharmacokinetics and Pharmacodynamics Assays
- G. Methods and Uses of Combination Therapy
  - 1. Cancers
  - 2. Selection of Subjects for Treatment
    - a. Measuring Hyaluronan Content of Tumors
      - i. Hyaluronan Binding Protein (HABP)
      - ii. Histochemical and Immunohistochemical Methods iii. Solid Phase Binding Assays
iv. In vivo Imaging Assays
b. Pre-Treatment Lymphocyte Count
3. Dosage and Administration
4. Dosage Regimen: Frequency and Cycle of Administration
5. Additional Combination Therapy
a. Corticosteroids
b. Anti-Cancer Agents and Other Treatments
H. Examples A. Definitions Unless defined otherwise, all technical and scientific terms used herein have the same meaning as is commonly understood by one of skill in the art to which the invention(s) belong. All patents, patent applications, published applications and publications, GenBank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, "combination therapy" refers to a treatment in which a subject if given two or more therapeutic agents, such as at least two or at least three therapeutic agents, for treating a single disease. For purposes herein, combination therapy includes therapy with a polymer-conjugated hyaluronan-degrading enzyme and an immune checkpoint protein blocking agent.

As used herein, "immune checkpoints" refer to inhibitory pathways of the immune system that are responsible for maintaining self-tolerance and modulating the duration and amplitude of physiological immune responses in peripheral tissues in order to minimize collateral tissue damage. Immune checkpoints are regulated by immune checkpoint proteins.

As used herein, an "immune checkpoint protein" is a protein, typically a receptor (e.g., CTLA4 or PD-1) or a ligand (e.g., PD-L1) that regulates or modulates the extent of an immune response. The immune checkpoint proteins can be inhibitory or stimulatory. In particular, the immune checkpoint proteins are inhibitory to the activation of the immune response. Thus, inhibition of an inhibitory immune checkpoint protein acts to stimulate or activate an immune response, such as T cell activation and proliferation.

As used herein, an "immune checkpoint inhibitor" or "immune checkpoint inhibiting agent," or "immune checkpoint blocking agent" refers to an agent that binds an inhibitory immune checkpoint protein and blocks its activity. The inhibition can be competitive or non-competitive inhibition that can be steric or allosteric. In cases where an immune checkpoint protein is an immune stimulating protein, an immune checkpoint inhibitor acts to promote the activity of the immune stimulating protein, such as by binding and activating the stimulatory immune checkpoint protein or by inhibiting by interfering with, such as by binding or deactivating, inhibitors of the stimulatory immune checkpoint protein. An example of an immune checkpoint inhibitor is an anti-immune checkpoint protein antibody.

A "target" of an immune checkpoint inhibitor is the immune checkpoint protein to which the immune checkpoint inhibitor or immune checkpoint inhibiting agent binds to block activity. Typically, the immune checkpoint inhibitor specifically binds to the target. For example, the target of the exemplary anti-CTLA4 antibody designated Ipilimumab is CTLA4.

As used herein, "antibody" refers to immunoglobulins and immunoglobulin fragments, whether natural or partially or wholly synthetically, such as recombinantly, produced, including any fragment thereof containing at least a portion of the variable heavy chain and light chain region of the immunoglobulin molecule that is sufficient to form an antigen binding site and, when assembled, to specifically bind antigen. Hence, an antibody includes any protein having a binding domain that is homologous or substantially homologous to an immunoglobulin antigen-binding domain (antibody combining site). For example, an antibody refers to an antibody that contains two heavy chains (which can be denoted H and H') and two light chains (which can be denoted L and L'), where each heavy chain can be a full-length immunoglobulin heavy chain or a portion thereof sufficient to form an antigen binding site (e.g., heavy chains include, but are not limited to, VH chains, VH-CH1 chains and VH-CH1-CH2-CH3 chains), and each light chain can be a full-length light chain or a portion thereof sufficient to form an antigen binding site (e.g., light chains include, but are not limited to, VL chains and VL-CL chains). Each heavy chain (H and H') pairs with one light chain (L and L', respectively). Typically, antibodies minimally include all or at least a portion of the variable heavy (VH) chain and/or the variable light (VL) chain. The antibody also can include all or a portion of the constant region.

For purposes herein, the term antibody includes full-length antibodies and portions thereof including antibody fragments. Antibody fragments, include, but are not limited to, Fab fragments, Fab' fragments, F(ab')$_2$ fragments, Fv fragments, disulfide-linked Fvs (dsFv), Fd fragments, Fd' fragments, single-chain Fvs (scFv), single-chain Fabs (scFab), diabodies, anti-idiotypic (anti-Id) antibodies, or antigen-binding fragments of any of the above. Antibody also includes synthetic antibodies, recombinantly produced antibodies, multispecific antibodies (e.g., bispecific antibodies), human antibodies, non-human antibodies, humanized antibodies, chimeric antibodies, and intrabodies. Antibodies provided herein include members of any immunoglobulin type (e.g., IgG, IgM, IgD, IgE, IgA and IgY), any class (e.g., IgG1, IgG2, IgG3, IgG4, IgA1 and IgA2) or subclass (e.g., IgG2a and IgG2b).

As used herein, a form of an antibody refers to a particular structure of an antibody. Antibodies herein include full length antibodies and portions thereof, such as, for example, an Fab fragment or other antibody fragment. Thus, an Fab is a particular form of an antibody.

As used herein, reference to a "corresponding form" of an antibody means that when comparing a property or activity of two antibodies, the property is compared using the same form of the antibody. For example, if it's stated that an antibody has less activity compared to the activity of the corresponding form of a first antibody, that means that a particular form, such as an Fab of that antibody, has less activity compared to the Fab form of the first antibody.

As used herein, a full-length antibody is an antibody having two full-length heavy chains (e.g., VH-CH1-CH2-

CH3 or VH-CH1-CH2-CH3-CH4) and two full-length light chains (VL-CL) and hinge regions, such as human antibodies produced by antibody secreting B cells and antibodies with the same domains that are produced synthetically.

As used herein, antibody fragment or antibody portion refers to any portion of a full-length antibody that is less than full length but contains at least a portion of the variable region of the antibody sufficient to form an antigen binding site (e.g., one or more CDRs) and thus retains the binding specificity and/or an activity of the full-length antibody; antibody fragments include antibody derivatives produced by enzymatic treatment of full-length antibodies, as well as synthetically, e.g., recombinantly produced derivatives. Examples of antibody fragments include, but are not limited to, Fab, Fab', F(ab)$_2$, single-chain Fvs (scFv), Fv, dsFv, diabody, Fd and Fd fragments (see, for example, *Methods in Molecular Biology*, Vol 207: *Recombinant Antibodies for Cancer Therapy Methods and Protocols* (2003); Chapter 1; p 3-25, Kipriyanov). The fragment can include multiple chains linked together, such as by disulfide bridges and/or by peptide linkers. An antibody fragment generally contains at least about 50 amino acids and typically at least 200 amino acids.

As used herein, an Fv antibody fragment is composed of one variable heavy domain ($V_H$) and one variable light ($V_L$) domain linked by noncovalent interactions.

As used herein, a dsFv refers to an Fv with an engineered intermolecular disulfide bond, which stabilizes the $V_H$-$V_L$ pair.

As used herein, an Fd fragment is a fragment of an antibody containing a variable domain ($V_H$) and one constant region domain ($C_H1$) of an antibody heavy chain.

As used herein, a Fab fragment is an antibody fragment that results from digestion of a full-length immunoglobulin with papain, or a fragment having the same structure that is produced synthetically, e.g., by recombinant methods. A Fab fragment contains a light chain (containing a $V_L$ and $C_L$) and another chain containing a variable domain of a heavy chain ($V_H$) and one constant region domain of the heavy chain ($C_H1$).

As used herein, a F(ab')$_2$ fragment is an antibody fragment that results from digestion of an immunoglobulin with pepsin at pH 4.0-4.5, or a fragment having the same structure that is produced synthetically, e.g., by recombinant methods. The F(ab')$_2$ fragment essentially contains two Fab fragments where each heavy chain portion contains an additional few amino acids, including cysteine residues that form disulfide linkages joining the two fragments.

As used herein, a Fab' fragment is a fragment containing one half (one heavy chain and one light chain) of the F(ab')$_2$ fragment.

As used herein, an Fd' fragment is a fragment of an antibody containing one heavy chain portion of a F(ab')$_2$ fragment.

As used herein, an Fv' fragment is a fragment containing only the $V_H$ and $V_L$ domains of an antibody molecule.

As used herein, hsFv refers to antibody fragments in which the constant domains normally present in a Fab fragment have been substituted with a heterodimeric coiled-coil domain (see, e.g., Arndt et al. (2001) *J Mol Biol.* 7:312:221-228).

As used herein, an scFv fragment refers to an antibody fragment that contains a variable light chain ($V_L$) and variable heavy chain ($V_H$), covalently connected by a polypeptide linker in any order. The linker is of a length such that the two variable domains are bridged without substantial interference. Exemplary linkers are (Gly-Ser)$_n$ residues with some Glu or Lys residues dispersed throughout to increase solubility.

As used herein, diabodies are dimeric scFv; diabodies typically have shorter peptide linkers than scFvs, and preferentially dimerize.

As used herein, a polypeptide "domain" is a part of a polypeptide (a sequence of three or more, generally 5, 10 or more amino acids) that is structurally and/or functionally distinguishable or definable. An exemplary polypeptide domain is a part of the polypeptide that can form an independently folded structure within a polypeptide made up of one or more structural motifs (e.g., combinations of alpha helices and/or beta strands connected by loop regions) and/or that is recognized by a particular functional activity, such as enzymatic activity, dimerization or antigen-binding. A polypeptide can have one or more, typically more than one, distinct domains. For example, the polypeptide can have one or more structural domains and one or more functional domains. A single polypeptide domain can be distinguished based on structure and function. A domain can encompass a contiguous linear sequence of amino acids. Alternatively, a domain can encompass a plurality of non-contiguous amino acid portions, which are non-contiguous along the linear sequence of amino acids of the polypeptide. Typically, a polypeptide contains a plurality of domains. For example, each heavy chain and each light chain of an antibody molecule contains a plurality of immunoglobulin (Ig) domains, each about 110 amino acids in length. Those of skill in the art are familiar with polypeptide domains and can identify them by virtue of structural and/or functional homology with other such domains. For exemplification herein, definitions are provided, but it is understood that it is well within the skill in the art to recognize particular domains by name. If needed, appropriate software can be employed to identify domains.

As used herein, a variable domain with reference to an antibody is a specific Ig domain of an antibody heavy or light chain that contains a sequence of amino acids that varies among different antibodies. Each light chain and each heavy chain has one variable region domain (VL and VH). The variable domains provide antigen specificity, and thus are responsible for antigen recognition. Each variable region contains CDRs that are part of the antigen binding site domain and framework regions (FRs).

As used herein, "hypervariable region," "HV," "complementarity-determining region," "CDR" and "antibody CDR" are used interchangeably to refer to one of a plurality of portions within each variable region that together form an antigen binding site of an antibody. Each variable region domain contains three CDRs, named CDR1, CDR2, and CDR3. The three CDRs are non-contiguous along the linear amino acid sequence, but are proximate in the folded polypeptide. The CDRs are located within the loops that join the parallel strands of the beta sheets of the variable domain.

As used herein, "antigen-binding domain," "antigen-binding site," "antigen combining site" and "antibody combining site" are used synonymously to refer to a domain within an antibody that recognizes and physically interacts with cognate antigen. A native conventional full-length antibody molecule has two conventional antigen-binding sites, each containing portions of a heavy chain variable region and portions of a light chain variable region. A conventional antigen-binding site contains the loops that connect the anti-parallel beta strands within the variable region domains. The antigen combining sites can contain other portions of the variable region domains. Each conventional antigen-binding site contains three hypervariable regions from the heavy chain and three hypervariable regions from the light chain. The hypervariable regions also are called complementarity-determining regions (CDRs).

As used herein, "portion thereof" with reference to an antibody heavy or light chain or variable heavy or light chain refers to a contiguous portion thereof that is sufficient to form an antigen binding site such that, when assembled into an antibody containing a heavy and light chain, it contains at least 1 or 2, typically 3, 4, 5 or all 6 CDRs of the variable heavy (VH) and variable light (VL) chains sufficient to retain at least a portion of the binding specificity of the corresponding full-length antibody containing all 6 CDRs. Generally, a sufficient antigen binding site requires CDR3 of the heavy chain (CDRH3). It typically further requires the CDR3 of the light chain (CDRL3). As described herein, one of skill in the art knows and can identify the CDRs based on Kabat or Chothia numbering (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917).

As used herein, framework regions (FRs) are the domains within the antibody variable region domains that are located within the beta sheets; the FR regions are comparatively more conserved, in terms of their amino acid sequences, than the hypervariable regions.

As used herein, a constant region domain is a domain in an antibody heavy or light chain that contains a sequence of amino acids that is comparatively more conserved among antibodies than the variable region domain. Each light chain has a single light chain constant region (CL) domain and each heavy chain contains one or more heavy chain constant region (CH) domains, which include, CH1, CH2, CH3 and CH4. Full-length IgA, IgD and IgG isotypes contain CH1, CH2, CH3 and a hinge region, while IgE and IgM contain CH1, CH2, CH3 and CH4. CH1 and CL domains extend the Fab arm of the antibody molecule, thus contributing to the interaction with antigen and rotation of the antibody arms. Antibody constant regions can serve effector functions, such as, but not limited to, clearance of antigens, pathogens and toxins to which the antibody specifically binds, e.g., through interactions with various cells, biomolecules and tissues.

As used herein, the phrase "derived from" or "derivative" when referring to antibody fragments derived from another antibody, such as a monoclonal antibody, refers to the engineering of antibody fragments (e.g., Fab, F(ab'), F(ab')$_2$, single-chain Fv (scFv), Fv, dsFv, diabody, Fd and Fd' fragments) that retain the binding specificity of the original or parent antibody. Such fragments can be derived by a variety of methods known in the art, including, but not limited to, enzymatic cleavage, chemical crosslinking, recombinant means or combinations thereof. Generally, the derived antibody fragment shares the identical or substantially identical heavy chain variable region ($V_H$) and light chain variable region ($V_L$) of the parent antibody, such that the antibody fragment and the parent antibody bind the same epitope.

As used herein, a "parent antibody" or "source antibody" refers the to an antibody from which an antibody fragment (e.g., Fab, F(ab'), F(ab)$_2$, single-chain Fv (scFv), Fv, dsFv, diabody, Fd and Fd' fragments) is derived.

As used herein, an anti-immune checkpoint protein antibody, refers to any antibody that specifically binds to an immune checkpoint protein or a soluble fragment thereof and blocks its activity or inhibits or reduces its activity. An anti-immune checkpoint protein antibody typically binds an immune checkpoint ligand protein or an immune checkpoint receptor protein and blocks the binding of a receptor to the target immune checkpoint ligand protein or a ligand to the target immune checkpoint receptor protein, thereby preventing the inhibitory signal transduction that suppresses an immune response. Hence, anti-immune checkpoint protein antibodies are immune checkpoint inhibitors. Reference to anti-immune checkpoint protein antibodies herein include full-length antibodies and antigen-binding fragments thereof that specifically bind to an immune checkpoint ligand or receptor protein. Exemplary anti-immune checkpoint protein antibodies include, but are not limited to, anti-cytotoxic T-lymphocyte-associated protein 4 (CTLA4) antibodies and anti-programmed cell death protein 1 (PD-1) antibodies.

As used herein, an antigen-binding fragment of an anti-immune checkpoint protein antibody refers to an antibody derived from an anti-immune checkpoint protein antibody but that is less than the full length sequence of the anti-immune checkpoint protein antibody but contains at least a portion of the variable regions (heavy and light) of the antibody sufficient to form an antigen binding site (e.g., one or more CDRs, and generally all CDRs) and thus retains the binding specificity and/or activity of the anti-immune checkpoint protein antibody.

As used herein, anti-CTLA4 antibody refers to any antibody that specifically binds to cytotoxic T-lymphocyte-associated protein 4 (CTLA4) or a soluble fragment thereof and blocks the binding of ligands to CTLA4, thereby resulting in competitive inhibition of CTLA4 and inhibition of CTLA4-mediated inhibition of T cell activation. Hence, anti-CTLA4 antibodies are CTLA4 inhibitors. Reference to anti-CTLA4 antibodies herein include a full-length antibody and derivatives thereof, such as antigen-binding fragments thereof that specifically bind to CTLA4. Exemplary anti-CTLA4 antibodies include, but are not limited to, Ipilimumab or Tremelimumab, or a derivative or antigen-binding fragment thereof.

As used herein, a cytotoxic T-lymphocyte-associated protein 4 (CTLA4; also known as CD152) antigen refers to an inhibitory receptor of the immunoglobulin superfamily, that is bound by ligands such as CD80 (also called B7-1) and CD86, (also called B7-2). CTLA4 includes human and non-human proteins. In particular, CTLA4 antigen includes human CTLA4, which has the sequence of amino acids set forth in SEQ ID NO: 10 (see e.g., GenBank Accession No. AAL07473.1).

As used herein, anti-PD-1 antibody refers to any antibody that specifically binds to programmed cell death protein 1 (PD-1) or a soluble fragment thereof and blocks the binding of ligands to PD-1, thereby resulting in competitive inhibition of PD-1 and inhibition of PD-1-mediated inhibition of T cell activation. Hence, anti-PD-1 antibodies are PD-1 inhibitors. Reference to anti-PD-1 antibodies herein include a full-length antibody and derivatives thereof, such as antigen-binding fragments thereof that specifically bind to PD-1. Exemplary anti-PD-1 antibodies include, but are not limited to, Nivolumab, MK-3475, Pidilizumab, or a derivative or antigen-binding fragment thereof.

As used herein, a programmed cell death protein 1 (PD-1) antigen refers to an inhibitory receptor, that is a type 1 membrane protein and is bound by ligands such as PD-L1 and PD-L2, which are members of the B7 family. PD-1 includes human and non-human proteins. In particular, PD-1 antigen includes human PD-1, which has the sequence of amino acids set forth in SEQ ID NO: 299 (see e.g., UniProt Accession No. Q15116.3).

As used herein, anti-PD-L1 antibody refers to an antibody that specifically binds to programed death-ligand 1 (PD-L1) or a soluble fragment thereof and blocking the binding of the ligand to PD-1, thereby resulting in competitive inhibition of PD-1 and inhibition of PD-1-mediated inhibition of T cell activity. Hence, anti-PD-L1 antibodies are PD-1 inhibitors. Reference to anti-PD-L1 antibodies herein include a full-length antibody and derivatives thereof, such as antigen-binding fragments thereof that specifically bind to PD-L1. Exemplary anti-PD-L1 antibodies include, but are not limited to, BMS-936559, MPDL3280A, MEDI4736 or a derivative or antigen-binding fragment thereof.

As used herein, "bind," "bound" or grammatical variations thereof refers to the participation of a molecule in any attractive interaction with another molecule, resulting in a stable association in which the two molecules are in close proximity to one another. Binding includes, but is not limited to, non-covalent bonds, covalent bonds (such as reversible and irreversible covalent bonds), and includes interactions between molecules such as, but not limited to, proteins, nucleic acids, carbohydrates, lipids, and small molecules, such as chemical compounds including drugs. Exemplary bonds are antibody-antigen interactions and receptor-ligand interactions. When an antibody "binds" a particular antigen, bind refers to the specific recognition of the antigen by the antibody, through cognate antibody-antigen interaction, at antibody combining sites. Binding also can include association of multiple chains of a polypeptide, such as antibody chains which interact through disulfide bonds.

As used herein, binding activity refers to characteristics of a molecule, e.g., a polypeptide, relating to whether or not, and how, it binds one or more binding partners. Binding activities include the ability to bind the binding partner(s), the affinity with which it binds to the binding partner (e.g., high affinity), the avidity with which it binds to the binding partner, the strength of the bond with the binding partner and/or specificity for binding with the binding partner.

As used herein, "affinity" or "binding affinity" describes the strength of the interaction between two or more molecules, such as binding partners, typically the strength of the noncovalent interactions between two binding partners. The affinity of an antibody or antigen-binding fragment thereof for an antigen epitope is the measure of the strength of the total noncovalent interactions between a single antibody combining site and the epitope. Low-affinity antibody-antigen interaction is weak, and the molecules tend to dissociate rapidly, while high affinity antibody-antigen-binding is strong and the molecules remain bound for a longer amount of time. Methods for calculating affinity are well-known, such as methods for determining association/dissociation constants. For example, a high antibody affinity means that the antibody specifically binds to a target protein with an equilibrium association constant ($K_A$) of greater than or equal to about $10^6$ $M^{-1}$, greater than or equal to about $10^7 M^{-1}$, greater than or equal to about $10^8$ $M^{-1}$, or greater than or equal to about $10^9$ $M^{-1}$, $10^{10}$ $M^{-1}$, $10^{11}$ $M^{-1}$ or $10^{12}$ $M^{-1}$. Antibodies also can be characterized by an equilibrium dissociation constant ($K_D$) $10^{-4}$ M, $10^{-6}$ M to $10^{-7}$M, or $10^{-8}$ M, $10^{-10}$ M, $10^{-11}$ M or $10^{-12}$M or lower. Affinity can be estimated empirically or affinities can be determined comparatively, e.g., by comparing the affinity of one antibody and another antibody for a particular antigen. For example, such affinities can be readily determined using conventional techniques, such as by equilibrium dialysis; by using the BIAcore 2000 instrument, using general procedures outlined by the manufacturer; by radioimmunoassay using radiolabeled target antigen; or by another method known to the skilled artisan. The affinity data can be analyzed, for example, by the method of Scatchard et al., Ann N.Y. Acad. Sci., 51:660 (1949).

As used herein, antibody avidity refers to the strength of multiple interactions between a multivalent antibody and its cognate antigen, such as with antibodies containing multiple binding sites associated with an antigen with repeating epitopes or an epitope array. A high avidity antibody has a higher strength of such interactions compared with a low avidity antibody.

As used herein, "affinity constant" refers to an association constant (Ka) used to measure the affinity of an antibody for an antigen. The higher the affinity constant the greater the affinity of the antibody for the antigen. Affinity constants are expressed in units of reciprocal molarity (i.e., $M^{-1}$) and can be calculated from the rate constant for the association-dissociation reaction as measured by standard kinetic methodology for antibody reactions (e.g., immunoassays, surface plasmon resonance, or other kinetic interaction assays known in the art). The binding affinity of an antibody also can be expressed as a dissociation constant, or Kd. The dissociation constant is the reciprocal of the association constant, Kd=1/Ka. Hence, an affinity constant also can be represented by the Kd.

As used herein, the term "the same," when used in reference to antibody binding affinity, means that the association constant (Ka) or dissociation constant (Kd) is within about 1 to 100 fold or 1 to 10 fold of the reference antibody (1-100 fold greater affinity or 1-100 fold less affinity, or any numerical value or range or value within such ranges, than the reference antibody).

As used herein, "substantially the same" when used in reference to association constant (Ka) or dissociation constant (Kd), means that the association constant is within about 5 to 5000 fold greater or less than the association constant, Ka, of the reference antibody (5-5000 fold greater or 5-5000 fold less than the reference antibody).

As used herein, "specifically bind" or "immunospecifically bind" with respect to an antibody or antigen-binding fragment thereof are used interchangeably herein and refer to the ability of the antibody or antigen-binding fragment to form one or more noncovalent bonds with a cognate antigen, by noncovalent interactions between the antibody combining site(s) of the antibody and the antigen. Typically, an antibody that immunospecifically binds (or that specifically binds) is one that binds to a target with an affinity constant Ka of about or $1 \times 10^7$ $M^{-1}$ or $1 \times 10^8$ $M^{-1}$ or greater (or a dissociation constant ($K_d$) of $1 \times 10^{-7}$ M or $1 \times 10^{-8}$ M or less). Affinity constants can be determined by standard kinetic methodology for antibody reactions, for example, immunoassays, surface plasmon resonance (SPR) (Rich and Myszka (2000) *Curr. Opin. Biotechnol* 11:54; Englebienne (1998) *Analyst.* 123:1599), isothermal titration calorimetry (ITC) or other kinetic interaction assays known in the art (see, e.g., Paul, ed., Fundamental Immunology, 2nd ed., Raven Press, New York, pages 332-336 (1989); see also U.S. Pat. No. 7,229,619 for a description of exemplary SPR and ITC methods for calculating the binding affinity of antibodies). Instrumentation and methods for real time detection and monitoring of binding rates are known and are commercially available (e.g., BIAcore 2000, BIAcore AB, Upsala, Sweden and GE Healthcare Life Sciences; Malmqvist (1999) *Biochem. Soc. Trans.* 27:335). Antibodies or antigen-binding fragments that immunospecifically bind to a particular antigen (e.g., EGFR) can be identified, for example, by immunoassays, such as radioimmunoassays (RIA), enzyme-linked immunosorbent assays (ELISAs), surface plasmon resonance, or other techniques known to those of skill in the art.

As used herein, an immune response is a response generated by an animal subject when lymphocytes identify an antigenic molecule as foreign and induce the formation of antibodies and lymphocytes capable of reacting with the foreign antigen and acting to remove the antigen. In particular, the antigenic molecule is an antigen associated with a tumor cell and the immune response is directed against the tumor cell.

As used herein, an enhanced immune response is an increase in activity associated with an immune response. Enhanced or increased immune activity can be measured by a variety of methods, including, but not limited to, an increase in circulating immune cells (e.g., lymphocytes) and an increase in lymphocytes that specifically recognize tumor antigens.

As used herein, an anti-tumor immune response is an immune response specifically directed against a tumor cell or tumor antigen.

As used herein, an anti-hyaluronan agent refers to any agent that modulates hyaluronan (HA) synthesis or degradation, thereby altering hyaluronan levels in a tissue or cell. For purposes herein, anti-hyaluronan agents reduce hyaluronan levels in a tissue or cell compared to the absence of the agent. Such agents include compounds that modulate the expression of genetic material encoding HA synthase (HAS) and other enzymes or receptors involved in hyaluronan metabolism, or that modulate the proteins that synthesize or degrade hyaluronan including HAS function or activity. The agents include small-molecules, nucleic acids, peptides, proteins or other compounds. For example, anti-hyaluronan agents include, but are not limited to, antisense or sense molecules, antibodies, enzymes, small molecule inhibitors and HAS substrate analogs.

As used herein, a hyaluronan-degrading enzyme refers to an enzyme that catalyzes the cleavage of a hyaluronan polymer (also referred to as hyaluronic acid or HA) into smaller molecular weight fragments. Exemplary hyaluronan-degrading enzymes are hyaluronidases, and particular chondroitinases and lyases that have the ability to depolymerize hyaluronan. Exemplary chondroitinases that are hyaluronan-degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase includes two enzymes, chondroitin-sulfate-ABC endolyase (EC 4.2.2.20) and chondroitin-sulfate-ABC exolyase (EC 4.2.2.21). Exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO: 253; Sato et al. (1994) *Appl. Microbiol. Biotechnol.* 41(1):39-46). Exemplary chondroitinase AC enzymes from the bacteria include, but are not limited to, those from *Flavobacterium heparinum*, set forth in SEQ ID NO: 254, *Victivallis vadensis*, set forth in SEQ ID NO: 255, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133).

As used herein, hyaluronidase refers to a class of hyaluronan-degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include, hyaluronidases from cows (SEQ ID NOS: 176-178 and BH55 (U.S. Pat. Nos. 5,747,027 and 5,827,721)), yellow jacket wasp (SEQ ID NOS: 171 and 172), honey bee (SEQ ID NO: 173), white-face hornet (SEQ ID NO: 174), paper wasp (SEQ ID NO: 175), mouse (SEQ ID NOS: 193-196), pig (SEQ ID NOS: 191, 192), rat (SEQ ID NOS: 198-201), rabbit (SEQ ID NO: 203), sheep (SEQ ID NOS: 184-187), chimpanzee (SEQ ID NO: 204), Rhesus monkey (SEQ ID NO: 202), orangutan (SEQ ID NO: 205), cynomolgus monkey (SEQ ID NO: 206), guinea pig (SEQ ID NO: 197), *Arthrobacter* sp. (strain FB24) (SEQ ID NO: 222), *Bdellovibrio bacteriovorus* (SEQ ID NO: 223), *Propionibacterium acnes* (SEQ ID NO: 224), *Streptococcus agalactiae* ((SEQ ID NO: 225); 18RS21 (SEQ ID NO: 226); serotype Ia (SEQ ID NO: 227); and serotype III (SEQ ID NO: 228)), *Staphylococcus aureus* (strain COL (SEQ ID NO: 229); strain MRSA252 (SEQ ID NOS: 230, 231); strain MSSA476 (SEQ ID NO: 232); strain NCTC 8325 (SEQ ID NO: 233); strain bovine RF122 (SEQ ID NOS: 234, 235); and strain USA300 (SEQ ID NO: 236)), *Streptococcus pneumoniae* ((SEQ ID NO: 237); strain ATCC BAA-255/R6 (SEQ ID NO: 238); and serotype 2, strain D39/NCTC 7466 (SEQ ID NO: 239)), *Streptococcus pyogenes* (serotype M1 (SEQ ID NO: 240); serotype M2, strain MGAS10270 (SEQ ID NO: 241); serotype M4, strain MGAS10750 (SEQ ID NO: 242); serotype M6 (SEQ ID NO: 243); serotype M12, strain MGAS2096 (SEQ ID NOS: 244, 245); serotype M12, strain MGAS9429 (SEQ ID NO: 246); and serotype M28 (SEQ ID NO: 247)); *Streptococcus suis* (SEQ ID NOS: 248-250); *Vibrio fischeri* (strain ATCC 700601/ES114 (SEQ ID NO: 251)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607). Hyaluronidases also include those of human origin. Exemplary human hyaluronidases include HYAL1 (SEQ ID NO: 218), HYAL2 (SEQ ID NO: 219), HYAL3 (SEQ ID NO: 220), HYAL4 (SEQ ID NO: 221), and PH20 (SEQ ID NO: 217). Also included amongst hyaluronidases are soluble hyaluronidases, including, ovine and bovine PH20, soluble human PH20 and soluble rHuPH20. Examples of commercially available bovine or ovine soluble hyaluronidases include Vitrase® (ovine hyaluronidase), Amphadase® (bovine hyaluronidase) and Hydase™ (bovine hyaluronidase).

As used herein, "purified bovine testicular hyaluronidase" refers to a bovine hyaluronidase purified from bovine testicular extracts (see U.S. Pat. Nos. 2,488,564, 2,488,565, 2,806,815, 2,808,362, 2,676,139, 2,795,529, 5,747,027 and 5,827,721). Examples of commercially available purified bovine testicular hyaluronidases include Amphadase® and Hydase™, and bovine hyaluronidases, including, but not limited to, those available from Sigma Aldrich, Abnova, EMD Chemicals, GenWay Biotech, Inc., Raybiotech, Inc., and Calzyme. Also included are recombinantly produced bovine hyaluronidases, such as but not limited to, those generated by expression of a nucleic acid molecule set forth in any of SEQ ID NOS: 181-183.

As used herein, "purified ovine testicular hyaluronidase" refers to an ovine hyaluronidase purified from ovine testicular extracts (see U.S. Pat. Nos. 2,488,564, 2,488,565 and 2,806,815 and International PCT Publication No. WO2005/118799). Examples of commercially available purified ovine testicular extract include Vitrase®, and ovine hyaluronidases, including, but not limited to, those available from Sigma Aldrich, Cell Sciences, EMD Chemicals, GenWay Biotech, Inc., Mybiosource.com and Raybiotech, Inc. Also included are recombinantly produced ovine hyaluronidases, such as, but not limited to, those generated by expression of a nucleic acid molecule set forth in any of SEQ ID NOS: 188-190.

As used herein, "PH20" refers to a type of hyaluronidase that occurs in sperm and is neutral-active. PH-20 occurs on the sperm surface, and in the lysosome-derived acrosome, where it is bound to the inner acrosomal membrane. PH20 includes those of any origin including, but not limited to, human, chimpanzee, Cynomolgus monkey, Rhesus monkey, murine, bovine, ovine, guinea pig, rabbit and rat origin. Exemplary PH20 polypeptides include those from human (SEQ ID NO: 217), chimpanzee (SEQ ID NO: 204), Rhesus monkey (SEQ ID NO: 202), Cynomolgus monkey (SEQ ID NO: 206), cow (e.g., SEQ ID NOS: 177, 178), mouse (SEQ ID NO: 196), rat (SEQ ID NO: 201), rabbit (SEQ ID NO: 203), sheep (SEQ ID NOS: 185-187) and guinea pig (SEQ ID NO: 197).

Reference to hyaluronan-degrading enzymes includes precursor hyaluronan-degrading enzyme polypeptides and mature hyaluronan-degrading enzyme polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NOS: 217 and 129, 130, 171-178, 184-187, 191-206 218-255, 258, 268-272, 274, 300, and 301, or the mature forms thereof. For example, reference to hyaluronan-degrading enzyme also includes the human PH20 precursor polypeptide variants set forth in SEQ ID NOS: 179, 180. Hyaluronan-degrading enzymes also include those that contain chemical or post-translational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art. A truncated PH20 hyaluronidase is any C-terminal shortened form thereof, particularly forms that are truncated and neutral active when N-glycosylated.

As used herein, a "soluble PH20" refers to any form of PH20 that is soluble under physiologic conditions. A soluble PH20 can be identified, for example, by its partitioning into the aqueous phase of a Triton® X-114 solution at 37° C. (Bordier et al., (1981) *J. Biol. Chem.,* 256:1604-7). Membrane-anchored PH20, such as lipid-anchored PH20, including GPI-anchored PH20, will partition into the detergent-rich phase, but will partition into the detergent-poor or aqueous phase following treatment with Phospholipase-C. Included among soluble PH20 are membrane-anchored PH20 in which one or more regions associated with anchoring of the PH20 to the membrane has been removed or modified, where the soluble form retains hyaluronidase activity. Soluble PH20 also includes recombinant soluble PH20 and those contained in or purified from natural sources, such as, for example, testes extracts from sheep or cows. An example of such soluble PH20 is soluble human PH20.

As used herein, soluble human PH20 or sHuPH20 includes PH20 polypeptides lacking all or a portion of the glycosylphosphatidylinositol (GPI) anchor sequence at the C-terminus such that upon expression, the polypeptides are soluble under physiological conditions. Solubility can be assessed by any suitable method that demonstrates solubility under physiologic conditions. An example of such methods is the Triton® X-114 assay, that assesses partitioning into the aqueous phase and that is described above and in the examples. In addition, a soluble human PH20 polypeptide is, if produced in CHO cells, such as CHO—S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion by CHO cells is definitional. Hence, if a polypeptide could be expressed and secreted by CHO cells and is soluble, i.e., partitions into the aqueous phase when extracted with Triton® X-114, it is a soluble PH20 polypeptide whether or not it is so-produced. The precursor polypeptides for sHuPH20 polypeptides can include a signal sequence, such as a heterologous or non-heterologous (i.e., native) signal sequence. Exemplary precursors are those that include a signal sequence, such as the native 35 amino acid signal sequence at amino acid positions 1-35 (see, e.g., amino acids 1-35 of SEQ ID NO: 217). Exemplary soluble human PH20 polypeptides include a PH20 polypeptide that has the sequence of amino acids set forth in any of SEQ ID NOS: 123-158, or a sequence of amino acids that exhibits at least 85%, 86%, 87%, 88%, 89%, 90%, 91%, 92%, 93%, 94%, 95%, 96%, 97%, 98% or 99% sequence identity to a sequence of amino acids set forth in any of SEQ ID NOS: 123-158 and retains hyaluronidase activity.

As used herein, "soluble recombinant human PH20 (rHuPH20)" refers to a composition containing the soluble form of human PH20 as recombinantly expressed and secreted in Chinese Hamster Ovary (CHO) cells. Soluble rHuPH20 is encoded by nucleic acid molecule that includes the signal sequence and is set forth in SEQ ID NO: 111. The nucleic acid encoding soluble rHuPH20 is expressed in CHO cells which secrete the mature polypeptide. As produced in the culture medium, there is heterogeneity at the C-terminus so that the product includes a mixture of species that can include any one or more of SEQ ID NO: 123-128 in various abundance.

As used herein, a "conjugate" refers to a polypeptide linked directly or indirectly to one or more other polypeptides or chemical moieties. Such conjugates include fusion proteins, those produced by chemical conjugates and those produced by any other methods. For example, a conjugate refers to hyaluronan-degrading enzyme, such as a hyaluronidase or soluble PH20 polypeptide, linked directly or indirectly to one or more other polypeptides or chemical moieties, whereby at least one soluble PH20 polypeptide is linked, directly or indirectly to another polypeptide or chemical moiety so long as the conjugate retains hyaluronidase activity.

As used herein, a "polymer-conjugated hyaluronan-degrading enzyme" refers to a hyaluronan-degrading enzyme that is linked directly or indirectly to a polymer. The linkage can be any type of linkage, including, but not limited to, ionic and covalent bonds, and any other sufficiently stable associated interaction. For example, a polymer-conjugated hyaluronan-degrading enzyme, includes a hyaluronidase or soluble PH20 polypeptide conjugated to a polymer. Reference to a polymer-conjugated hyaluronan-degrading enzyme means that the conjugate exhibits hyaluronidase activity. Typically, the polymer-conjugate exhibits at least 20%, 30%, 40%, 50%, 60%, 70%, 80%, 90% or more of the hyaluronidase activity compared to the hyaluronan-degrading enzyme that is not conjugated to a polymer.

As used herein, an "N-linked moiety" refers to an asparagine (N) amino acid residue of a polypeptide that is capable of being glycosylated by post-translational modification of a polypeptide. Exemplary N-linked moieties of human PH20 include amino acids N82, N166, N235, N254, N368 and N393 of human PH20 set forth in SEQ ID NO: 217.

As used herein, a "polymer" refers to any high molecular weight natural or synthetic moiety that is made up of repeating unites. Polymers include, but are not limited to, polyethylene glycol moieties, dextran, cellulose and sialic acid. These and other exemplary polymers are described herein, and many are known in the art. For purposes herein, the polymer can be conjugated to, i.e., stably linked directly or indirectly via a linker, to a polypeptide. Such polymer conjugates, typically increase serum half-life, and include, but are not limited to sialic moieties, PEGylation moieties, dextran, and sugar and other moieties, such as glycosylation. For example, hyaluronidases, such as a soluble PH20 or rHuPH20, can be conjugated to a polymer.

As used herein, "PEGylated" refers to covalent or other stable attachment of polymeric molecules, such as polyethylene glycol (PEGylation moiety PEG) to proteins, including hyaluronan-degrading enzymes, such as hyaluronidases, typically to increase half-life of the hyaluronan-degrading enzyme.

As used herein, an anti-cancer agent or chemotherapeutic agent refers to an agent that is capable of killing cells that divide rapidly, such as cancer cells. One of skill in the art is familiar with anti-cancer agents, including chemotherapeutic agents. Exemplary agents are described herein.

As used herein, a prodrug is a compound which exhibits pharmacologic activity after biotransformation. For example, nucleoside analogs such as gemcitabine are prodrugs, whereby activity occurs as a result of intracellular conversion to two active metabolites, gemcitabine diphosphate and gemcitabine triphosphate by deoxycytidine kinase. The triphosphate (diflurorodeoxycytidine triphosphate) competes with endogenous deoxynucleoside triphosphates for incorporation into DNA.

As used herein, a derivative with reference to a drug refers to a form of a drug that has undergone change or modification from a reference drug or agent, but still retains activity (e.g., exhibits increased or decreased activity) compared to the reference drug or agent. Typically a derivative form of a compound means that a side chain of the compound has been modified or changed.

As used herein, an analogue or analog of a drug or agent is a drug or agent that is related to a reference drug, but whose chemical and biological activities can be different. Typically, analogues exhibit similar activities to a reference drug or agent, but the activity can be increased or decreased or otherwise improved. Typically, an analogue form of a compound or drug means that the backbone core of the structure is modified or changed compared to a reference drug.

As used herein, "activity" refers to a functional activity or activities of a polypeptide or portion thereof associated with a full-length (complete) protein. For example, active fragments of a polypeptide can exhibit an activity of a full-length protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor, ligand or antigen.

As used herein, "hyaluronidase activity" refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc., Rockville, Md.). A Reference Standard solution can be used in an assay to ascertain the relative activity, in units, of any hyaluronidase. In vitro assays to determine the hyaluronidase activity of hyaluronidases, such as PH20, including soluble PH20 and esPH20, are known in the art and described herein. Exemplary assays include the microturbidity assay that measures cleavage of hyaluronic acid by hyaluronidase indirectly by detecting the insoluble precipitate formed when the uncleaved hyaluronic acid binds with serum albumin and the biotinylated-hyaluronic acid assay that measures the cleavage of hyaluronic acid indirectly by detecting the remaining biotinylated-hyaluronic acid non-covalently bound to microtiter plate wells with a streptavidin-horseradish peroxidase conjugate and a chromogenic substrate. Reference Standards can be used, for example, to generate a standard curve to determine the activity in Units of the hyaluronidase being tested.

As used herein, specific activity refers to Units of activity per mg protein. The milligrams of hyaluronidase is defined by the absorption of a solution of at 280 nm assuming a molar extinction coefficient of approximately 1.7, in units of $M^{-1} cm^{-1}$.

As used herein, "neutral active" refers to the ability of a PH20 polypeptide to enzymatically catalyze the cleavage of hyaluronic acid at neutral pH (e.g., at or about pH 7.0).

As used herein, a "GPI-anchor attachment signal sequence" is a C-terminal sequence of amino acids that directs addition of a preformed GPI-anchor to the polypeptide within the lumen of the ER. GPI-anchor attachment signal sequences are present in the precursor polypeptides of GPI-anchored polypeptides, such as GPI-anchored PH20 polypeptides. The C-terminal GPI-anchor attachment signal sequence typically contains a predominantly hydrophobic region of 8-20 amino acids, preceded by a hydrophilic spacer region of 8-12 amino acids, immediately downstream of the w-site, or site of GPI-anchor attachment. GPI-anchor attachment signal sequences can be identified using methods well-known in the art. These include, but are not limited to, in silico methods and algorithms (see, e.g., Udenfriend et al. (1995) *Methods Enzymol.* 250:571-582, Eisenhaber et al., (1999) *J. Biol. Chem.* 292: 741-758, Fankhauser et al., (2005) *Bioinformatics* 21:1846-1852, Omaetxebarria et al., (2007) *Proteomics* 7:1951-1960, Pierleoni et al., (2008) BMC Bioinformatics 9:392), including those that are readily available on bioinformatic websites, such as the ExPASy Proteomics tools site (e.g., the World Wide Web site expasy.ch/tools/).

As used herein, "nucleic acids" include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleotides long.

As used herein, a peptide refers to a polypeptide that is greater than or equal to 2 amino acids in length, and less than or equal to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH2 refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3557-3559 (1968), and adopted 37 C.F.R. §§ 1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is defined to include the amino acids listed in the Table of Correspondence (Table 1) and modified and unusual amino acids, such as those referred to in 37 C.F.R. §§ 1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH.

As used herein, the "naturally occurring α-amino acids" are the residues of those 20 α-amino acids found in nature which are incorporated into protein by the specific recognition of the charged tRNA molecule with its cognate mRNA codon in humans. Non-naturally occurring amino acids thus include, for example, amino acids or analogs of amino acids other than the 20 naturally-occurring amino acids and include, but are not limited to, the D-stereoisomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g., Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G, eds., Humana Press, New Jersey, 1994; Sequence Analysis in Molecular Biology, von Heinje, G, Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well-known to skilled artisans (Carrillo, H. & Lipman, D., SIAM J Applied Math 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G, eds., Humana Press, New Jersey, 1994; Sequence Analysis in Molecular Biology, von Heinje, G, Academic Press, 1987; and Sequence Analysis Primer, Gribskov, M. and Devereux, J., eds., M Stockton Press, New York, 1991; Carrillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I):387 (1984)), BLASTP, BLASTN, FASTA (Altschul, S. F., et al., *J Mol Biol* 215:403 (1990)); Guide to Huge Computers, Martin J. Bishop, ed., Academic Press, San Diego, 1994, and Carrillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) J. Mol. Biol. 48:443, as revised by Smith and Waterman ((1981) Adv. Appl. Math. 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., ATLAS OF PROTEIN SEQUENCE AND STRUCTURE, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g., by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g., an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90%, 95% or greater identity with a wildtype and/or predominant form, including 96%, 97%, 98%, 99% or greater identity with a wildtype and/or predominant form of a polypeptide. Reference to an allelic variant herein generally refers to variations in proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human. For example for PH20, exemplary species variants provided herein are primate PH20, such as, but not limited to, human, chimpanzee, macaque and cynomolgus monkey. Generally, species variants have 70%, 75%, 80%, 85%, 90%, 91%, 92%, 93%, 94%, 95%, 96%, 97%, 98% or more sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98%, or equal to or greater than 99%. The position of interest is then given the number assigned in the reference nucleic acid molecule. Alignment can be effected manually or by eye, particularly, where sequence identity is greater than 80%.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements (e.g., substitutions) of amino acids and nucleotides, respectively. Exemplary modifications are amino acid substitutions. An amino-acid substituted polypeptide can exhibit 65%, 70%, 80%, 85%, 90%, 91%, 92%, 93%, 94%, 95%, 96%, 97%, 98% or more sequence identity to a polypeptide not containing the amino acid substitutions. Amino acid substitutions can be conservative or non-conservative. Generally, any modification to a polypeptide retains an activity of the polypeptide. Methods of modifying a polypeptide are routine to those of skill in the art, such as by using recombinant DNA methodologies.

As used herein, suitable conservative substitutions of amino acids are known to those of skill in the art and can be made generally without altering the biological activity of the resulting molecule. Those of skill in the art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in Table 2 as follows:

TABLE 2

| Conservative Amino Acid Substitution: | |
|---|---|
| Original residue | Exemplary conservative substitution |
| Ala (A) | Gly; Ser |
| Arg (R) | Lys |
| Asn (N) | Gln; His |

TABLE 2-continued

Conservative Amino Acid Substitution:

| Original residue | Exemplary conservative substitution |
|---|---|
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to a substantially purified polypeptide, such as a substantially purified soluble PH20, refers to preparations of proteins that are substantially free of cellular material and includes preparations of proteins in which the protein is separated from cellular components of the cells from which it is isolated or recombinantly-produced. In one embodiment, the term substantially free of cellular material includes preparations of enzyme proteins having less than about 30% (by dry weight) of non-enzyme proteins (also referred to herein as a contaminating protein), generally less than about 20% of non-enzyme proteins or 10% of non-enzyme proteins or less than about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means or using recombinant DNA methods means the use of the well-known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well-known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, and a polyadenylation signal. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well-known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein the term "assessing" is intended to include quantitative and qualitative determination in the sense of obtaining an absolute value for the activity of a protein, such as an enzyme, or a domain thereof, present in the sample, and also of obtaining an index, ratio, percentage, visual or other value indicative of the level of the activity. Assessment can be direct or indirect. For example, the chemical species actually detected need not of course be the enzymatically cleaved product itself but can for example be a derivative thereof or some further substance. For example, detection of a cleavage product can be a detectable moiety such as a fluorescent moiety.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a hyaluronidase enzyme is its degradation of hyaluronic acid. Biological activity of an immune checkpoint inhibitor can include, but is not limited to, binding an immune checkpoint protein, inhibiting or stimulating activity of the immune checkpoint protein, induction of an increased immune response, and/or induction of a tumor-specific immune response.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity), a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, direct administration refers to a composition that is administered without dilution.

As used herein, a single dosage formulation refers to a formulation for use only once. Typically, a single dosage formulation is for direct administration.

As used herein, a multiple dosage formulation refers to a formulation for use in repeat administrations.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are hyaluronan-associated diseases and disorders.

As used herein, "intravenous administration" refers to delivery of a therapeutic directly into a vein.

As used herein, a "hyaluronan-associated cancer" or "hyaluronan rich cancers" include cancers in which hyaluronan levels are elevated as cause, consequence or otherwise observed in the disease or condition. Hyaluronan-associated cancers or tumors are associated with elevated hyaluronan levels in a tissue or cell, increased interstitial fluid pressure, decreased vascular volume, and/or increased water content in a tissue. Such cancers include, for example, tumors, including solid tumors such as late-stage cancers, metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers.

As used herein, hyaluronan (HA; also known as hyaluronic acid or hyaluronate) refers to a naturally occurring polymer of repeated disaccharide units of N-acetylglucosamine and D-glucuronic acid. Hyaluronan is produced by certain tumors.

As used herein, elevated hyaluronan levels refers to amounts of hyaluronan in particular tissue, body fluid or cell, dependent upon the disease or condition, consequence or otherwise observed in the disease. For example, as a consequence of the presence of a hyaluronan-rich tumor, hyaluronan (HA) levels can be elevated in body fluids, such as blood, urine, saliva and serum, and/or in the tumorous tissue or cell. The level can be compared to a standard or other suitable control, such as a comparable sample from a subject who does not have the HA-associated disease.

As used herein, an HA score refers to a semi-quantitative score of HA positivity levels on cell members and stroma of tumors. The score can be determined by detection of HA in tumor tissue, such as formalin-fixed and paraffin-embedded tissue, by histochemistry methods, such as immunohistochemistry or pseudo immunohistochemistry methods, for HA using a hyaluronan binding protein (HABP), (also referred to as hyaladherins). The degree of stain on cells and stroma can be determined visually under a microscope or by available computer algorithm programs and software. For example, images can be quantitatively analyzed using a pixel count algorithm for HA stain (e.g., Aperio Spectrum Software and other standard methods that measure or quantitate or semi-quantitate the degree of staining). In such an example, a ratio of strong positive stain (such as brown stain) to the sum of total stained area can be calculated and scored, where if the ratio is more than 25% strong positive stain to total stain the tumor tissue is scored as $HA^{+3}$, if the ratio is 10-25% of strong positive stain to total stain the tumor tissue is scored as $HA^{+2}$ if the ratio is less than 10% of strong positive stain to total stain the tumor tissue is scored as $HA^{+1}$, and if the ratio of strong positive stain to total stain is 0 the tumor tissue is scored as 0. The Aperio method, as well as software therefor, are known to those of skill in the art (see, e.g., U.S. Pat. Nos. 8,023,714; 7,257,268). A tumor is graded or scored as $HA^{High}$ ($HA^{+3}$) at strong HA staining over 25% of tumor section; as $HA^{Moderate}$ ($HA^{+2}$) at strong HA staining between 10 and 25% of tumor section; and as $HA^{Low}$)$HA^{+1}$) at strong HA staining under 10% of tumor section.

As used herein, "moderate HA" with reference to the amount or level of HA in a tissue or body fluid sample refers to the degree or extent of HA in the tissue or body fluid sample as compared to a normal or healthy tissue or body fluid sample. The amount of HA is moderate if the amount is at about 1.3-fold to 2-fold or higher than the amount or level of HA in a corresponding normal, control or healthy tissue. It is understood that the amount of HA can be determined and quantitated or semi-quantitated using methods such as solid-phase binding assays or histochemistry. For example, the amount can be based on comparison of plasma levels or comparison of staining intensity (e.g., percent positive pixels) as determined by histochemistry.

For example, moderate HA exists if the HA score by histochemistry or other method is $HA^{+2}$ and/or if there is HA staining over 10-25% of tumor section. For example, moderate HA exists if there is a ratio of strong positive stain (such as brown stain) to the sum of total stained area that is more than 25% strong positive stain to total stain the tumor tissue.

As used herein, "high HA" with reference to the amount or level of HA in a tissue or body fluid sample refers to the degree or extent of HA in the tissue or body fluid sample as compared to a normal or healthy tissue or body fluid sample. The amount of HA is high if the amount is at least or at least about 2.5-fold, 3-fold, 4-fold, 5-fold, 6-fold, 7-fold, 8-fold, 9-fold, 10-fold, 20-fold, 30-fold, 40-fold, 50-fold, 60-fold, 70-fold or higher than the amount or level of HA in a corresponding normal, control or healthy tissue. It is understood that the amount of HA can be determined and quantitated or semi-quantitated using methods such as solid-phase binding assays or histochemistry. For example, the amount can be based on comparison of plasma levels or comparison of staining intensity (e.g., percent positive pixels) as determined by histochemistry. For example, high HA exists if the HA score by histochemistry or other method is $HA^{+3}$ and/or if there is HA staining over 25% of tumor section. For example, high HA exists if there is a ratio of strong positive stain (such as brown stain) to the sum of total stained area that is more than 25% strong positive stain to total stain the tumor tissue.

As used herein, a "hyaluronan binding protein" (HA binding protein; HABP or hyaladherin) refers to any protein that specifically binds to HA to permit detection of the HA. The binding affinity is one that has as an association constant Ka that is at least about or is at least $10^7 M^{-1}$. The HA binding protein can be recombinantly produced or synthetic protein(s), or can be a protein derived from a biological source or physiologic source, such as cartilage. HA binding proteins include HA binding domains, including link modules that bind to HA and sufficient portions thereof that specifically binds to HA to permit detection thereof. Hence, HABPs include any protein that contains a hyaluronan binding region or domain or a sufficient portion thereof to specifically bind HA. Exemplary hyaluronan binding regions are link modules (link domains) or G1 domains. A sufficient portion includes at least 10, 20, 30, 40, 50, 60, 70, 80, 90, 95 or more contiguous amino acids of a binding domain or link module. HA binding proteins also include fusion proteins containing an HA binding protein and one or more additional polypeptides, including multimerization domains. Exemplary HA binding proteins include but are not limited to aggrecan, versican, neurocan, brevican, phosphacan, TSG-6, TSG-6 mutants, such as those provided herein, including polypeptides containing HA binding domains and link modules thereof that bind to HA.

As used herein, "hyaluronan-binding domain" or "HA-binding domain" refers to a region or domain of an HABP polypeptide that specifically binds to hyaluronan with a binding affinity that has as an association constant Ka that is at least about or is at least $10^6 M^{-1}$ or $10^7 M^{-1}$ or greater or a dissociation constant Kd that is less than $10^{-6}$ M or $10^{-7}$ M or less. Exemplary hyaluronan-binding domains include, for example, link modules (also called link domains herein) or G1 domains, or sufficient portions of a link module or G1 domain that specifically binds to HA.

As used herein, "multimer" with reference to a hyaluronan binding protein refers to an HABP that contains multiple HA binding sites, for example, at least 2, 3, or 4 HA binding sites. For example, an HABP multimer refers to a HABP that contains at least 2 link modules that are each capable of binding to HA. For example, a multimer can be generated by linking, directly or indirectly, two or more link modules (e.g., TSG-6 link module). The linkage can be facilitated using a multimerization domain, such as an Fc protein.

As used herein, a "multimerization domain" refers to a sequence of amino acids that promotes stable interaction of a polypeptide molecule with another polypeptide molecule containing a complementary multimerization domain, which can be the same or a different multimerization domain to form a stable multimer with the first domain. Generally, a polypeptide is joined directly or indirectly to the multimerization domain. Exemplary multimerization domains include the immunoglobulin sequences or portions thereof, leucine zippers, hydrophobic regions, hydrophilic regions, compatible protein-protein interaction domains such as, but not limited to an R subunit of PKA and an anchoring domain (AD), a free thiol that forms an intermolecular disulfide bond between two molecules, and a protuberance-into-cavity (i.e., knob into hole) and a compensatory cavity of identical or similar size that form stable multimers. The multimerization domain, for example, can be an immunoglobulin constant region. The immunoglobulin sequence can be an immunoglobulin constant domain, such as the Fc domain or portions thereof from IgG1, IgG2, IgG3 or IgG4 subtypes, IgA, IgE, IgD and IgM.

As used herein, "Fc" or "Fc region" or "Fc domain" refers to a polypeptide containing the constant region of an antibody heavy chain, excluding the first constant region immunoglobulin domain. Thus, Fc refers to the last two constant region immunoglobulin domains of IgA, IgD, and IgE, or the last three constant region immunoglobulin domains of IgE and IgM. Optionally, an Fc domain can include all or part of the flexible hinge N-terminal to these domains. For IgA and IgM, Fc can include the J chain. An exemplary Fc domain of IgG contains immunoglobulin domains Cγ2 and Cγ3, and optionally all or part of the hinge between Cγ1 and Cγ2. The boundaries of the Fc region can vary, but typically, include at least part of the hinge region. In addition, Fc also includes any allelic or species variant or any variant or modified form, such as any variant or modified form that alters the binding to an FcR or alters an Fc-mediated effector function. Exemplary sequences of other Fc domains, including modified Fc domains are known.

As used herein, normal levels or values can be defined in a variety of ways known to one of skill in the art. Typically, normal levels refer to the expression levels of a HA across a healthy population. The normal levels (or reference levels) are based on measurements of healthy subjects, such as from a specified source (i.e., blood, serum, tissue, or other source). Often, a normal level will be specified as a "normal range", which typically refers to the range of values of the median 95% of the healthy population. Reference value is used interchangeably herein with normal level but can be different from normal levels depending on the subjects or the source. Reference levels are typically dependent on the normal levels of a particular segment of the population. Thus, for purposes herein, a normal or reference level is a predetermined standard or control by which a test patient can be compared.

As used herein, "elevated level" refers to any level of amount or expression of HA above a recited or normal threshold.

As used herein, "biological sample" refers to any sample obtained from a living or viral source or other source of macromolecules and biomolecules, and includes any cell type or tissue of a subject from which nucleic acid or protein or other macromolecule can be obtained. The biological sample can be a sample obtained directly from a biological source or to sample that is processed. For example, isolated nucleic acids that are amplified constitute a biological sample. Biological samples include, but are not limited to, body fluids, such as blood, plasma, serum, cerebrospinal fluid, synovial fluid, urine and sweat, tissue and organ samples from animals, including biopsied tumor samples.

As used herein, "detection" includes methods that permit visualization (by eye or equipment) of a protein. A protein can be visualized using an antibody specific to the protein. Detection of a protein can also be facilitated by fusion of a protein with a tag including an epitope tag or label.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease.

As used herein, a "pharmaceutically effective agent," includes any therapeutic agent or bioactive agents, including, but not limited to, for example, chemotherapeutics, anesthetics, vasoconstrictors, dispersing agents, conventional therapeutic drugs, including small molecule drugs and therapeutic proteins.

As used herein, "treatment" means any manner in which the symptoms of a condition, disorder or disease or other indication, are ameliorated or otherwise beneficially altered.

As used herein, "therapeutic effect" means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a "patient" refers to a human subject exhibiting symptoms of a disease or disorder.

As used herein, "about the same" means within an amount that one of skill in the art would consider to be the same or to be within an acceptable range of error. For example, typically, for pharmaceutical compositions, within at least 1%, 2%, 3%, 4%, 5% or 10% is considered about the same. Such amount can vary depending upon the tolerance for variation in the particular composition by subjects.

As used herein, "dosing regimen" refers to the amount of agent, for example, the composition containing an anti-hyaluronan agent, for example a soluble hyaluronidase or other agent, administered, and the frequency of administration. The dosing regimen is a function of the disease or condition to be treated, and thus can vary.

As used herein, "frequency" of administration refers to the time between successive administrations of treatment. For example, frequency can be days, weeks or months. For example, frequency can be more than once weekly, for example, twice a week, three times a week, four times a week, five times a week, six times a week or daily. Frequency also can be one, two, three or four weeks. The particular frequency is a function of the particular disease or condition treated. Generally, frequency is more than once weekly, and generally is twice weekly.

As used herein, a "cycle of administration" refers to the repeated schedule of the dosing regimen of administration of the enzyme and/or a second agent that is repeated over successive administrations. For example, an exemplary cycle of administration is a 28 day cycle with administration twice weekly for three weeks, followed by one-week of discontinued dosing.

As used herein, when referencing dosage based on mg/kg of the subject, an average human subject is considered to have a mass of about 70 kg-75 kg, such as 70 kg and a body surface area (BSA) of 1.73 $m^2$.

As used herein, amelioration of the symptoms of a particular disease or disorder by a treatment, such as by administration of a pharmaceutical composition or other therapeutic, refers to any lessening, whether permanent or temporary, lasting or transient, of the symptoms or, adverse effects of a condition, such as, for example, reduction of adverse effects associated with or that occur upon administration of an anti-hyaluronan agent, such as a PEGylated hyaluronidase.

As used herein, "prevention" or "prophylaxis" refers to reduction in the risk of developing a disease or condition.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, "unit dose form" refers to physically discrete units suitable for human and animal subjects and packaged individually as is known in the art.

As used herein, a single dosage formulation refers to a formulation as a single dose.

As used herein, formulation for direct administration means that the composition does not require further dilution for administration.

As used herein, an "article of manufacture" is a product that is made and sold. As used throughout this application, the term is intended to encompass anti-hyaluronan agents, for example hyaluronan-degrading enzyme, such as hyaluronidase, and immune checkpoint inhibitor compositions contained in articles of packaging.

As used herein, "fluid" refers to any composition that can flow. Fluids thus encompass compositions that are in the form of semi-solids, pastes, solutions, aqueous mixtures, gels, lotions, creams and other such compositions.

As used herein, a "kit" refers to a combination of components, such as a combination of the compositions herein and another item for a purpose including, but not limited to, reconstitution, activation, and instruments/devices for delivery, administration, diagnosis, and assessment of a biological activity or property. Kits optionally include instructions for use.

As used herein, a cellular extract or lysate refers to a preparation or fraction which is made from a lysed or disrupted cell.

As used herein, peripheral blood is blood that can be collected from the a vein and/or artery. Collection of peripheral blood can be distal or proximal to a region of interest, such as a tumor.

As used herein, animal includes any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal. The hyaluronidases provided herein are from any source, animal, plant, prokaryotic and fungal. Most hyaluronidases are of animal origin, including mammalian origin. Generally hyaluronidases are of human origin.

As used herein, anti-cancer treatments include administration of drugs and other agents for treating cancer, and also treatment protocols, such as surgery and radiation. Anti-cancer treatments include administration of anti-cancer agents.

As used herein, an anti-cancer agent refers to any agents, or compounds, used in anti-cancer treatment. These include any agents, when used alone or in combination with other compounds, that can alleviate, reduce, ameliorate, prevent, or place or maintain in a state of remission of clinical symptoms or diagnostic markers associated with tumors and cancer, and can be used in combinations and compositions provided herein. Exemplary anti-cancer agents include, but are not limited to, hyaluronan-degrading enzymes, such as the PEGylated hyaluronan-degrading enzymes provided herein used singly or in combination with other anti-cancer agents, such as chemotherapeutics, polypeptides, antibodies, peptides, small molecules or gene therapy vectors, viruses or DNA.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound comprising or containing "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Immune Checkpoint Inhibitor and Hyaluronan-Degrading Enzyme Combination Therapy Provided herein are combination therapies for use in the treatment of cancers that include an anti-hyaluronan agent, such as a hyaluronan-degrading enzyme (e.g., a soluble hyaluronidase, such as a PH20), and an agent that increases the immune response by blocking an immune checkpoint protein (i.e., immune checkpoint inhibitor). The anti-hyaluronan agent, such as a hyaluronan-degrading enzyme (e.g., a soluble hyaluronidase, such as PH20) is modified or formulated or provided to exhibit an increased half-life in the plasma. Generally the hyaluronan-degrading enzyme is modified by conjugation to a polymer. As described herein, the hyaluronan-degrading enzyme can be formulated for sustained release or local release or delivery such as in a vector that encodes it.

For example, provided herein are combination therapies for use in the treatment of cancers. The combinations include a polymer-conjugated hyaluronan-degrading enzyme, for example a hyaluronidase, such as PEGPH20, and an agent that increases the immune response by blocking an immune checkpoint protein (i.e., immune checkpoint inhibitor). In the combination therapies provided herein, the immune checkpoint inhibitor can be an antibody directed against an immune checkpoint protein, such as an antibody directed against cytotoxic T-lymphocyte antigen 4 (CTLA-4 or CD152) or programmed cell death ligand-1 (PDL-1) or programmed cell death protein 1 (PD-1).

In particular, the combination therapy provided herein is used in the treatment of any cancers characterized by solid tumors that have a phenotype of at least moderate to high hyaluronan (HA), and also to stromal solid tumors. Exemplary cancers include solid tumor cancers, such as but not limited to, pancreatic cancer, breast cancer, lung cancer, such as non-squamous cell lung cancer (NSCLC), prostate cancer, gastric cancer, colon cancer, ovarian cancer, head and neck cancer and others. The combination therapy can further include a further cytotoxic chemotherapeutic drug or radionuclide therapy or surgery, such as surgical resection.

1. Solid Tumors and Immune Response

Many cancers develop mechanisms to evade anti-tumor immune responses. These mechanisms can be intrinsic to tumor cells or mediated by other cells. Mechanisms intrinsic to tumor cells include loss of expression of antigens that elicit immune responses. For example, the high mitotic rate and genetic instability of tumor cells, in the presence of a functioning host immune system, can lead to selection of mutations or deletions of genes that encode tumor antigens that are not required for growth of the tumors or maintenance of the transformed phenotype. For example, some tumor cells do not express co-stimulators, such as CD80 and CD86, required for T cell responses or class II major histocompatibility complex (MHC) molecules, which are required for the activation of helper T cells. By eliminating antigens, or preventing the expression of ligands which are required for immune activation, tumor cells can evade T cell—mediated immune responses.

Tumor cells also can suppress anti-tumor responses by secretion of immunosuppressive cytokines, such as transforming growth factor beta (TGF-β), that can inhibit the proliferation and effector functions of lymphocytes and macrophages.

Tumors also can evade the immune response by inhibiting access of immune cells to the tumor antigens. For example, tumor antigens can be masked from the immune system by expression of glycocalyx molecules, such as sialic acid-containing mucopolysaccharides, on the tumor cell surface. In addition, tumors, such as solid tumors, are made up of cancer cells and stroma cells (e.g., fibroblasts and inflammatory cells) that are surrounded by an extracellular matrix and vascular network. The stromal cells, extracellular matrix components and/or vasculature generally are abnormal compared to those present in normal tissues. For example, many solid tumors have an increased number of fibroblasts compared to normal tissues. Also, the vasculature in solid tumors can exhibit a branched or convoluted structure compared to normal vasculature, and exhibit structural aberrations characterized by dilated vessels, reduction in endothelial lining and/or compressed vessels. Finally, the tumor and stromal cells produce and assemble a complex network of extracellular matrix components, such as collagens, proteoglycans, glycosaminoglycans (e.g., hyaluronan) and other molecules that form a dense mass and can contribute to high tumor interstitial pressure. The high interstitial fluid pressure above the intravascular pressure in the terminal arterioles and capillaries can impair perfusion of fluids and solutes into the interstitium and prevent access of cells of the immune response, such as tumor infiltrating lymphocytes, to the tumor surface.

2. Immune Checkpoint Modulation of T Cell Activity in Tumors

Under normal physiological conditions, the T cell-mediated immune response is initiated by antigen recognition by the T cell receptor (TCR) and is regulated by a balance of co-stimulatory and inhibitory signals (i.e., immune checkpoint proteins). The immune system relies on immune checkpoints to prevent autoimmunity (i.e., self-tolerance) and to protect tissues from excessive damage during an immune response, for example during an attack against a pathogenic infection. In some cases, however, immune-checkpoint proteins can be dysregulated in tumors as a mechanism for evading the immune system.

Therapies for treating cancers include immunotherapies (e.g., inhibitory checkpoint protein antagonists or agonists) that inhibit immunosupprressive signaling or enhance immunostimulant signaling. Instead of directly targeting the tumor itself, such therapies use the host's endogenous defenses to combat the tumor. For example, inhibitory checkpoint protein antagonists and/or agonists of co-stimulatory receptors can stimulate a host's endogenous anti-tumor immune response by amplifying antigen-specific T cell responses. Enhancing the host's immune response offers the advantage over cytotoxic therapies in that the effects can be long lasting, such that the subject can develop a durable anti-tumor response that can persist for months to years after cessation of treatment.

In particular examples, the combination therapies provided herein employ an agent (e.g., antibody) that targets an inhibitory checkpoint protein. Exemplary inhibitory immune checkpoint target proteins and therapeutic antibodies for the targets are provided in Table 3.

PD-1 function as negative regulators, each plays a non-redundant role in modulating immune responses: CTLA-4 is involved in attenuating the early activation of naïve and memory (resting) T cells; whereas PD-1 plays a role in modulating T cell activity in peripheral tissues (see, e.g., Keir et al. (2008) *Annu Rev Immunol.* 26:677-704; Pardoll, (2012) *Nat Rev Cancer.* 12(4):252-264; Quezada et al., (2013) *Br J Cancer.* 108(8):1560-1565; Callahan et al., (2010) *Semin Oncol.* 37(5):473-84). These activities, and inhibition of these targets in tumor immunotherapy, are described in further detail below.

a. CTLA-4 and T Cell Priming

T cell-mediated immunity involves the steps of priming, which is initiated by clonal selection of antigen-specific T cells followed by activation and proliferation of selected T cells in lymphoid tissues, trafficking of activated T cells to sites of antigen and inflammation, and the execution of direct effector functions to target cells. Each of these steps is regulated by counterbalancing stimulatory and inhibitory signals that fine-tune the amplitude of the immune response.

T cell priming, which includes the consecutive steps of selection of antigen-specific T cells and activation and proliferation of the selected T cells, occurs in the lymph nodes. Naïve and resting T cells express T cell receptor (TCR) and high levels of the co-stimulatory receptor, CD28 on the cell surface. TCRs bind antigen peptides bound to major histocompatibility complex (MHC) molecules on the surface of an antigen presenting cell (APC), such as a dendritic cell or macrophage. APCs also express CD80 (also called B7.1) or CD86 (also called B7.2), the ligands for CD28. Upon TCR binding its peptide: MHC antigen and recognition of CD80 or CD86 by the co-stimulating T cell receptor, CD28, expressed on the T-cell, signal transduction occurs within the T cell to initiate T cell activation.

Cytotoxic T-lymphocyte-associated antigen 4 (CTLA4; also called CD152) is a co-inhibitory receptor that is pack-

TABLE 3

Exemplary inhibitory immune checkpoint target proteins and inhibitors

| Target | Target Function | Antibody/fusion protein | Synonyms and Code Names |
|---|---|---|---|
| CTLA4 | Inhibitory receptor | Ipilimumab | (MDX-CTLA-4; BMS-734016; MDX-010) |
| | | Tremelimumab | (ticilimumab; CP-675,206) |
| PD-1 | Inhibitory receptor | MK-3475 | (Pembrolizumab; Lambrolizumab; SCH 900475) |
| | | AMP-224 | (anti-PD-1 fusion protein AMP-224) |
| | | Nivolumab | (BMS-936558; MDX-1106; ONO-4538) |
| | | Pidilizumab | (CT-011) |
| PD-L1 | Ligand for PD-1 | MDX-1105 | (RG7446) |
| | | BMS-936559 | |
| | | MED14736 | |
| | | MPDL33280A | |
| LAG3 | Inhibitory receptor | IMP321 | ImmuFact |
| B7-H3 | Inhibitory ligand | MGA271 | |
| B7-H4 | Inhibitory ligand | | |
| TIM3 | Inhibitory receptor | | |
| CD25 | inhibitory receptor subunit | | |
| CD137 | stimulatory receptor | | |
| OX40 | stimulatory receptor | | |
| 4-1BB | co-stimulatory receptor | Aptamer ligand | |
| IDO | immunosuppressive enzyme | | |

In particular, inhibitors of the immunologic inhibitory molecules CTLA4 and PD-1 are contemplated for the combinations and methods provided herein. While CTLA4 and aged in vesicles that are maintained in the cytoplasm of naïve or resting T cells. When CD28-initiated signal transduction initiate T cell activation, it also triggers transportation of the vesicles containing CTLA4 to the surface of the T cell. CTLA4 competes with CD28 for binding CD80 and CD86 on the APC, and CTLA4 has a higher binding affinity for the antigens than CD28. The inhibitory activity of CTLA4 acts to dampen the amplitude of the stimulatory CD28 signal. Thus, T cell activation and proliferation depends on the ratio of CD28 (stimulatory) to CTLA4 (inhibitory) signals. In this role, CTLA4 functions to reduce T-cell activity and thereby limit autoimmunity. CTLA4 also plays a role in down-modulation of helper T cell activity and in enhancing regulatory T ($T_{reg}$) cell activity.

Tumors eradication can occur by killing of tumor cells by cytotoxic T lymphocytes (CTL) specific for tumor antigens. CD4+ T helper cells also can play a role in the immune response to tumors by activating antigen-specific effector cells and recruiting cells of the innate immune system to the tumor, such as macrophages. Most tumors, however, can evade the immune system. This can occur by the failure of tumors to express antigens that can be recognized by the immune system. Also, many tumors can aberrantly express costimulatory and inhibitory molecules so that, on balance, there is a reduced activation of CTLs and helper T cells. For example, tumors can express low levels of the CD80 or CD86 costimulatory molecule, thereby resulting in preferential engagement of the inhibitory receptor CTLA-4 rather than the stimulatory receptor CD28. Also, some tumors can induce regulatory T cells, which also suppress antitumor immune responses.

Inhibition of CTLA4, for example by administering anti-CTLA4 antibodies, can enhance the immune response by increasing the activity of CTLs, increasing the presence of effector and helper T cells and/or by inhibiting the suppressive functions of $T_{reg}$ cells. Inhibition of CTLA4 allows full activation of the T cells during the priming phase of the immune response.

As listed in Table 3 above, two antibodies that block CTLA4, Ipilimumab and Tremelimumab, have been used for the effective treatment of some cancers, such as melanoma, pancreatic cancer, ovarian cancer, prostate cancer, renal cell cancer (RCC), colorectal cancer (CRC), gastric cancer, and NSCLC (see Kyi et al., (2014) *FEBS Letters* 588:368-376 for a review). Therapeutic CTLA4 blockade can effect tumor regression months to years after completion of therapy (Prieto et al., (2012) *Clin Cancer Res.* 18(7): 2039-2047; Kirkwood et al., (2010) *Clin Cancer Res.* 16(3): 1042-1048), but also can reduce tolerance to other host tissues, leading to adverse events, such as immune-related adverse events (irAEs).

b. PD-1 and T-Cell Effector Phase

Following activation in the lymph node, activated T cells enter the blood stream and travel to peripheral tissues to carry out T cell effector functions. Expression of programmed cell death protein 1 (PD-1), a receptor that inhibits T cell activation, is induced upon T cell activation. PD-1 also is present on regulatory T ($T_{reg}$) cells, exhausted T cells, activated B cells, natural killer (NK) cells, dendritic cells (DCs) and activated monocytes.

PD-1 has two principal ligands, PD-1 ligand 1 (PD-L1; also called B7-H1 or CD274) and PD-L2 (also called B7-DC or CD273). Inflammatory signals in tissues induce the expression of PD-L1 and PD-L2. Upon binding one of its ligands, PD-1 acts to attenuate T cell activity, by inhibiting signaling of the T cell receptor (TCR), downregulating the secretion of immunostimulatory cytokines and expression of survival proteins, and increasing T cell production of the immunosuppressive cytokine IL-10. These activities serve to limit collateral tissue damage and limit autoimmunity during an immune response under normal conditions.

Multiple tumors and cells in the tumor microenvironment of cancers such as urothelial ovarian, breast, cervical, colon, pancreatic, gastric, melanoma, glioblastoma and NSCL cancers, express PD-L1 and/or PD-L2 (Zou and Chen, (2008) *Nat. Rev. Immunol.* 8(6):467-477; Rozali et al., (2012) *Clin Dev Immunol.* 2012: 656340). When PD-1 binds to its ligand on tumor cells, T cell activity is attenuated which prevents tumor rejection and thus contributes to tumor immune evasion. Expression of PD-L1 by tumors has been linked to poor prognosis in several cancers (Hamid and Carvajal, (2013) *Expert Opin Biol Ther.* 13(6):847-861).

Blocking the PD-1 signaling pathway results in restoration of T cell effector functions, such as tumor-specific T cell effector functions, such as killing tumor cells and secretion of immunostimulatory cytokines, such as interferon gamma (IFNγ), interleukin-2 (IL-2) and tumor necrosis factor alpha (TNF-α). Therapies, including therapies employing monoclonal antibodies, such as those set forth above in Table 3, can be used to block the interaction between PD-1 and PD-L1 or PD-L2 as a strategy to augment the antitumor immune response. Anti-PD-1 antibodies that disrupt PD-1 signaling include Nivolumab, MK-3745, and Pidilizumab.

c. Other Immunomodulatory Agents (e.g., LAG-3)

Other immune checkpoint ligands and receptors are involved in modulating the immune response and can be targets for therapies aimed at enhancing antitumor immunity. Further, blockade of two or more of coordinately expressed receptors or ligands can produce additive or synergistic antitumor activities.

Targets include B7 inhibitory ligands, other than PD-L1 and PD-L2, such as B7-H3 and B7-H4, which are upregulated on tumor cells or tumor infiltrating cells. Other targets, which are associated with inhibition of lymphocyte activity, include lympocyte activation gene 3 (LAG3; also called CD223), 2B4 (also called CD244), B and T lymphocyte attenuator (BTLA; or CD272), T cell membrane protein 3 (TIM3; or HAVcr2), Adenosine A2a receptor (A2aR), and the family of killer inhibitory receptors. Many of these immune checkpoint receptors regulate the activity of effector T cells and $T_{reg}$ cells. For example, LAG3 is highly expressed on $T_{reg}$ cells (which help prevent autoimmunity), where it is thought to be important for amplifying immunosuppressive activity. LAG3 also is associated with inhibition of effector T-cell activity and may induce T-cell anergy (Pardoll, (2012) *Nat Rev Cancer.* 12(4):252-264. Antibody targeting of these proteins alone or in combination can enhance antitumor immunity in animal cancer models. Because many tumor cells express multiple inhibitory ligands, and tumor infiltrating lymphocytes express multiple inhibitory receptors, a combinatorial approach to inhibiting these proteins can be effective in enhancing antitumor immunity (see Pardoll, (2012) *Nat Rev Cancer.* 12(4):252-264 for a review).

In addition to secreted or membrane-bound inhibitory ligands, metabolic enzymes such as indoleamine 2,3 dioxygenase (IDO) and arginase, which are expressed by inhibitory myeloid-derived suppressor cells that commonly infiltrate tumors, can locally inhibit immune responses by depleting amino acids essential for anabolic metabolism of T cells. These enzymes can be inhibited by small molecule drugs.

3. Polymer-Conjugated Hyaluronan-Degrading Enzyme in Combination Therapy with an Immune Checkpoint Inhibitor Hyaluronan (HA) is a major component of the extracellular matrix of solid tumors. HA is a high molecular weight linear glycosaminoglycan that contains repeating disaccharide units, β-1,3 N-acetyl-D-glucosamine-linked β-1,4 to D-glucuronic acid. HA occurs naturally in the body and is secreted at extremely high levels in some cancer cells, including pancreatic, lung (e.g., NSCL), and breast cancer cells. Local aberrations of HA metabolism have been reported in many solid tumor malignancies, where elevated levels of HA frequently correlate with poor prognosis in tumors such as breast, gastric, colorectal, ovarian, prostate and lung carcinoma. In particular, HA is involved in increased water uptake and interstitial fluid pressure (IFP) in disease tissues, such as tumors, thereby resulting in compressed tumor vasculature. For example, at sites of inflammation or in a tumor focus, there is rapid accumulation of hyaluronan, other matrix components and water. Because of this rapid accumulation, the diseased site cannot come to equilibrium with its environment and therefore has a higher IFP than normal tissues.

As discussed above, the IFP of most solid tumors and other diseased tissues associated with accumulated HA is elevated, acting as a barrier to efficient drug delivery (Heldin et al. (2004) *Nat Rev Cancer* 4(10):806-813). HA accumulation also reduces contact inhibition between and among tumor cells (see, e.g., Itano et al. (2002) *Proc. Natl. Acad. Sci. U.S.A.* 99:3609-3614). In addition to creating a physical barrier, tumor-derived hyaluronan also can induce immunosuppressive macrophages through transient early activation of monocytes (Kuang et al., (2007) *Blood* 110(2):587-595) thereby allowing the tumor cells to avoid immune response and creating conditions for tumor progression.

Hyaluronan-degrading enzymes, such as hyaluronidase enzymes, are enzymes that interfere with and degrade hyaluronic acid. Hyaluronan-degrading enzymes, e.g., hyaluronidases (e.g., PH20), can reduce hyaluronan such that the tissue deflates, the blood vessels expand, and more blood can flow through the site. This results in a diminishment of the interstitial fluid pressure at the tissue site and an associated increase in vascular perfusion. In addition, hyaluronan-degrading enzymes (e.g., soluble hyaluronidase, for example PH20) can deplete the stroma surrounding cancer cells by degrading HA. By virtue of effects to degrade hyaluronan, hyaluronan-degrading enzymes (e.g., soluble hyaluronidase, for example PH20) have been used for the treatment of tumors and cancers in single treatment therapy or in combination therapy with other agents (see e.g., U.S. published application No. US2006/0104968 and US20100003238; and International published PCT Appl. No WO 2009/128917).

Treatment of tumors generally requires systemic administration. The use of hyaluronidase, such as a PH20 enzyme, as a systemic treatment suffers from problems associated with short half-life of the enzyme. For example, unmodified hyaluronidase typically has a short half-life of enzymatic activity in blood of minutes, generally less than 5 minutes. This means that such enzymes are generally unsuitable for use in intravenous administrations, and other administrations, where their duration of action is short-lived. This is because following degradation, the HA substrate is replaced with a half-life of approximately 5 h. In contrast, methods that increase the delivery and/or prolong the association of a hyaluronidase with cell-associated hyaluronan (e.g., tumor-associated pericellular hyaluronan) allows for treatment of tumors rich in HA (e.g., $HA^{high}$ tumors). Such methods can include, but are not limited to, conjugation of the enzyme to a polymer, the use of an enzyme that is aglycosylated or that is modified to have reduced glycosylation, continuous infusion of the enzyme and/or localized delivery of the enzyme. For example, polymer-modification of hyaluronidase, such as by PEGylation, increases the half-life of the enzyme to approximately 48 to 72 hours and allows for the systemic treatment of tumors rich in HA (see e.g., U.S. published application No. 20100003238 and International published PCT Appl. No. WO 2009/128917). The increased half-life relative to unmodified hyaluronidase permits continued removal of HA, and thereby reduces or decreases the extent of regeneration of HA within diseased tissues, such as the tumor. Thus, maintenance of plasma enzyme levels by polymer conjugation can remove HA, such as tumor HA, and also counteract HA resynthesis.

It is found herein that combination therapy of a hyaluronan-degrading enzyme, such as a polymer-conjugated hyaluronan-degrading enzyme, for example a PEGylated soluble hyaluronidase (e.g., PEGPH20) and an immune checkpoint inhibitor exhibit a substantial increase in efficacy for treating tumors (particularly $HA^{high}$ tumors) than either agent alone. In particular, such results are evident when the enzyme is pre-administered to the subject prior to administering the immune checkpoint inhibitor.

Since immune checkpoint inhibitors act on immune cells to enhance immune responses, the increased response when provided in combination with a hyaluronan-degrading enzyme, such as a polymer-conjugated hyaluronan-degrading enzyme, can be due to effects on increasing access of immune cells (e.g., CTLs) to the tumor. For example, as described above, tumor and stromal cells produce and assemble a complex network of extracellular matrix components, such as collagens, proteoglycans, glycosaminoglycans (e.g., hyaluronan) and other molecules that form a dense mass that can inhibit infiltration of lymphocytes and other immune cells. By degrading hyaluronan, there can be an increased access of circulating immune cells into the tumors, thereby increasing the number of cytotoxic and other immune cells available to kill tumor cells. The penetration of anti-tumor agents or drugs, such as immune checkpoint inhibitors (e.g., anti-CTLA4 antibody), also can be increased. It is also possible that hyaluronan degradation improves the surface contact between immune cells, such as cytotoxic T cells, and tumor cells, which also results in an enhanced tumor cell killing when combined in combination with an immune checkpoint inhibitor.

Hence, the use of a hyaluronan-degrading enzyme, such as a polymer-conjugated hyaluronan-degrading enzyme, for example a PEGylated soluble hyaluronidase (e.g., PEGPH20), such as by pre-administration, can sensitize a tumor to immune-mediated responses, which can be further increased in the presence of an immune checkpoint inhibitor (e.g., anti-CTLA4 antibody). Enhancing the accessibility of immune cells to the tumor by a polymer-conjugated hyaluronan-degrading enzyme, for example as achieved by pre-administration of the enzyme, can allow for reduced dosage of the immune checkpoint inhibitor, while maintaining therapeutic efficacy. The ability to more effectively fine tune the antibody dosage can result in a reduction in adverse events that can be associated with the antibody therapy. Thus, the combination therapy provided herein can facilitate an enhanced anti-tumor immune response for the eradication of tumors and tumor treatment.

C. Combination Therapy Agents

Provided herein are combination therapies of anti-hyaluronan agents, such as polymer-conjugated hyaluronan-degrading enzymes and other forms thereof, such as vesicles containing an hyaluronan-degrading enzyme and vector encoding it, and an immune checkpoint inhibitor, such as inhibitors of immune checkpoint proteins, such as anti-CTLA4 and anti-PD-1 agents, for use in the treatment of cancers. In particular, provided herein are combination therapies of a polymer-conjugated hyaluronan-degrading enzyme, for example a hyaluronidase, such as PEGPH20, and immune checkpoint inhibitors, such as anti-CTLA4 and anti-PD-1 agents, for use in the treatment of cancers. For purposes of embodiments herein, reference to a hyaluronan-degrading enzyme (e.g., a soluble hyaluronidase, such as PH20), includes polymer-conjugated hyaluronan-degrading enzymes (e.g., polymer-conjugated soluble hyaluronidase polypeptides, such as PEGPH20). In particular, the combination therapy provided herein is used in the treatment of any cancers characterized by solid tumors that are characterized by having moderate to high levels of HA in the extracellular matrix (i.e., HA$^{moderate}$ to HA$^{high}$ tumors). Examples of such cancers include solid tumor cancers, such as but not limited to, pancreatic cancer, breast cancer, prostate cancer, gastric cancer, colon cancer, ovarian cancer, head and neck cancer, lung cancer and others. The combination therapy can further include a further immune targeting agent, cytotoxic chemotherapeutic drug, radiotherapy, or surgical treatment.

Non-limiting, examples of immune checkpoint inhibitors and anti-hyaluronan agents, including polymer-conjugated hyaluronan-degrading enzymes, for use in the combination therapy are provided in the following subsections.

1. Immune Checkpoint Inhibitors and Formulations Thereof

The combination therapy, including compositions, combinations and methods and use thereof, provided herein contains inhibitors of immune checkpoint proteins that block an immune checkpoint protein to stimulate an anti-tumor immune response. Such immune checkpoint inhibitors are known in the art. Examples of such inhibitors are described in Section B, and include any inhibitory agent that targets an inhibitory checkpoint protein described in Table 3. For example, the immune checkpoint protein or agent is an inhibitor of CTLA4 and PD-1. In particular examples, the immune checkpoint inhibitor is an antibody or an aptamer. Table 3 in Section B provides non-limiting examples of immune checkpoint inhibitors. Exemplary inhibitors of CTLA4 and PD-1 include anti-CTLA4 and anti-PD-1 antibodies and aptamers.

An inhibitor that is an aptamer can be employed in the combination therapy provided herein. An aptamer includes oligonucleotide (DNA, RNA, or XNA) or peptide aptamers. An aptamer can be monovalent or multivalent, such as bivalent or tetravalent. In some cases, the aptamer can be modified by polymers, such as cholesterol or polyethylene glycol (PEG) to extend the half-life of circulating aptamers.

In particular examples, the immune checkpoint inhibitor is an antibody that blocks an immune checkpoint molecule (e.g., anti-CTLA4 or anti-PD-1). The antibody can be a full-length antibody or an antigen-binding fragment thereof that immunospecifically binds to the immune checkpoint molecule (e.g., CTLA4 or PD-1). A full-length antibody contains four polypeptide chains, two identical heavy (H) chains (each usually containing about 440 amino acids) and two identical light (L) chains (each containing about 220 amino acids). The full-length antibody chains are organized into variable (V) and constant (C) region domains. Light chains have two domains, corresponding to the C region ($C_L$) and the V region ($V_L$). Heavy chains have four domains, the V region (VH) and three or four domains in the C region ($C_H1$, $C_H2$, $C_H3$ and $C_H4$), and, in some cases, a hinge region. Each heavy chain is linked to a light chain by a disulfide bond, and the two heavy chains are linked to each other by disulfide bonds. Linkage of the heavy chains is mediated by a flexible region of the heavy chain, known as the hinge region.

The variable domains confer antigen-specificity to the antibody through three portions called complementarity determining regions (CDRs) or hypervariable (HV) regions. The CDR regions are precisely defined and universally numbered in antibodies (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917; AbM (Martin et al. (1989) *Proc Natl Acad Sci USA* 86:9268-9272; Martin et al. (1991) *Methods Enzymol* 203:121-153; Pedersen et al. (1992) *Immunomethods* 1:126-136). Together, the three heavy chain CDRs and the three light chain CDRs make up an antigen-binding site (antibody combining site) of the antibody, which physically interacts with cognate antigen and provides the specificity of the antibody.

The constant region promotes activation of complement and effector cells. Like CDR regions, constant regions are precisely defined and universally numbered in antibodies using EU index and Kabat numbering schemes (see e.g., Kabat, E. A. et al. (1991) *Sequences of Proteins of Immunological Interest*, Fifth Edition, U.S. Department of Health and Human Services, NIH Publication No. 91-3242). The constant region can be any immunoglobulin class (e.g., IgG IgM, IgD, IgE, IgA and IgY), any subclass (e.g., IgG1, IgG2, IgG3, IgG4, IgA1 and IgA2) or sub-subclass (e.g., IgG2a and IgG2b). In particular examples, the antibodies in the combination therapy provided herein are full-length antibodies containing an IgG1 heavy chain constant region set forth in any of SEQ ID NOS: 288-292. an IgG2 constant region set forth in SEQ ID NO: 293, an IgG3 constant region set forth in SEQ ID NO: 294. or an IgG4 constant region set forth in SEQ ID NO: 295. The antibodies in the combination therapy provided herein also can contain a kappa (κ) or lambda (λ) light chain constant region, such as a human lambda light chain constant region set forth in SEQ ID NO: 297, or a kappa light chain constant region set forth in SEQ ID NO: 296 or 298.

For purposes of the combination therapies provided herein, any antigen-binding fragment of a full-length antibody inhibitor, such as derivatives of full-length antibodies that contain less than the full sequence of the full-length antibodies but retain at least a portion of the specific binding abilities of the full-length antibody (e.g., the variable portions of the heavy and light chain) can be employed in the combination therapy provided herein. The antibody fragments also can include antigen-binding portions of an antibody that can be inserted into an antibody framework (e.g., chimeric antibodies) in order to retain the binding affinity of the parent antibody. Examples of antibody fragments include, but are not limited to, Fab, Fab', F(ab')$_2$, single-chain Fv (scFv), Fv, dsFv, diabody, Fd and Fd' fragments, and other fragments, including modified fragments (see, for example, Methods in Molecular Biology, Vol. 207: Recombinant Antibodies for Cancer Therapy Methods and Protocols (2003); Chapter 1; p 3-25, Kipriyanov). Antibody fragments can include multiple chains linked together, such as by disulfide bridges and can be produced recombinantly. Antibody fragments also can contain synthetic linkers, such as peptide linkers, to link two or more domains. Methods for generating antigen-binding fragments are well-known known in the art and can be used to modify any antibody provided herein. Fragments of antibody molecules can be generated, such as for example, by enzymatic cleavage. For example, upon protease cleavage by papain, a dimer of the heavy chain constant regions, the Fc domain, is cleaved from the two Fab regions (i.e., the portions containing the variable regions).

Non-limiting examples of antibody and other immune checkpoint inhibitor therapies are provided below.

a. Anti-CTLA4 Therapies

The combination therapies provided herein, including compositions and methods and uses thereof, include therapeutic agents that inhibit CTLA4. Inhibitors include antibodies and aptamers. Antibody and aptamer inhibitors that bind to CTLA4 and inhibit CTLA4 signaling are known. Exemplary aptamers which bind CTLA4, inhibit CTLA4 function, and enhance tumor immunity have been described and are set forth in SEQ ID NOS: 11-18 (Santulli-Marotto (2003) *Cancer Res.* 63(21):7483-7489; Gilboa et al., (2013) *Clin Cancer Res* 19(5):1054-1062).

Several antibodies, which bind and inhibit CTLA4 activity, have been described which have been used in anti-tumor immunotherapy. Anti-CTLA4 antibodies include, but are not limited to, any of those described in U.S. Pat. Nos. 6,682,736, 6,984,720; U.S. Publ. Nos. 2002/0086014; 2009/0074787; European Patent No. EP 1262193; and International Patent Publication No. WO 2000/037504. In particular, anti-CTLA4 antibodies include Ipilimumab (also called MDS-010 or 10D1) and Tremelimumab (also called Ticilimumab or CP-675,206). These anti-CTLA4 antibodies have been involved in numerous clinical trials for the treatment of cancers. Ipilimumab is FDA approved for the treatment of melanoma and has been in clinical trials for other cancers, such as prostate cancer, lung cancer, and RCC. Tremelimumab has been investigated in clinical trials for the treatment of CRC, gastric cancer, melanoma and NSCLC.

i. Ipilimumab and Derivatives Thereof

An anti-CTLA4 antibody for use in the combination therapy provided herein can include Ipilimumab (also called MDX-010, MDX-101, 10D1; Drug Bank Accession No. DB06186) or derivatives thereof, such as variants or antigen-binding fragments of Ipilimumab. Ipilimumab is a fully human IgG1κ monoclonal antibody that specifically binds human CTLA4 (see, e.g., antibody designated 10D1 in US Patent Publication No. 2002/0086014 and U.S. Pat. No. 6,984,720). The heavy chain of Ipilimumab has a variable domain ($V_H$) with the sequence of amino acids set forth in SEQ ID NO: 22, encoded by the sequence of nucleotides set forth in SEQ ID NO: 21. The complementarity determining regions (CDRs) of the heavy chain include $V_H$ CDR 1 (set forth in SEQ ID NO: 25); $V_H$ CDR 2 (set forth in SEQ ID NO: 26); and $V_H$ CDR 3 (set forth in SEQ ID NO: 27). The light chain of Ipilimumab has a variable domain ($V_L$) with the sequence of amino acids set forth in SEQ ID NO: 24, encoded by the sequence of nucleotides set forth in SEQ ID NO: 23. The CDRs of the light chain include, $V_L$ CDR 1 (set forth in SEQ ID NO: 28); $V_L$ CDR 2 (set forth in SEQ ID NO: 29); and $V_L$ CDR 3 (set forth in SEQ ID NO: 30). When recombinantly produced, Ipilimumab is made up of four polypeptide chains; two identical heavy chains of 447 amino acids each and two identical kappa light chains of 215 amino acids each. Each heavy and light chain pair is linked through an interchain disulfide bond.

The anti-CTLA4 antibody in the combination therapy provided herein also include antigen-binding fragments of full-length Ipilimumab or variants thereof. An antigen-binding fragment minimally contains a variable heavy chain and/or variable light chain of Ipilimumab, or a sufficient portion thereof to form an antigen-binding site sufficient to bind CTLA4. Hence, the antibody can be any form of an antibody as long as, when it is produced or assembled into an antibody, it minimally contains a sufficient portion of the variable heavy chain and a sufficient portion of the variable light chain to immunospecifically bind CTLA4. For example, anti-CTLA4 antibodies for use in the combination therapy provided herein include antigen-binding fragments of Ipilimumab that minimally contain a variable heavy chain ($V_H$) with a sequence of amino acids set forth in SEQ ID NO: 22 and a variable light chain ($V_L$) with a sequence of amino acids set forth in SEQ ID NO: 24, or a sufficient portion of SEQ ID NO: 22 and SEQ ID NO: 24 to form an antigen-binding site to immunospecifically bind CTLA4. For example, examples of antibody fragments include, but are not limited to, Fab, Fab', F(ab')$_2$, single-chain Fv (scFv), Fv, dsFv, diabody, Fd and Fd' fragments.

The anti-CTLA4 antibody in the combination therapy provided herein also can include variants of Ipilimumab, or antigen-binding fragments thereof that include the variations. For example, an anti-CTLA4 antibody can include an antibody containing a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 22 and a variable light chain that has a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 24, where the variant antibody immunospecifically binds CTLA-4. The variation can be an amino acid replacement, insertion or deletion of amino acids. In some cases, only the heavy chain is varied. In other cases, only the light chain is varied. In still other cases, both the heavy chain and light chain are varied compared to the parental Ipilimumab antibody.

ii. Tremelimumab and Derivatives Thereof

An anti-CTLA4 antibody for use in the combination therapy provided herein can include Tremelimumab (also called Ticilimumab, CP-675,206 or 11.2.1) or derivatives thereof, such as variants or antigen-binding fragments of Tremelimumab. Tremelimumab is a fully human IgG2 monoclonal antibody that specifically binds human CTLA4 (see e.g., antibody designated 11.2.1 of International Patent Publication No. WO 00/37504). The heavy chain of Tremelimumab has a variable domain ($V_H$) with the sequence of amino acids set forth in SEQ ID NO: 34, encoded by the sequence of nucleotides set forth in SEQ ID NO: 33. The complementarity determining regions (CDRs) of the heavy chain include $V_H$ CDR 1 (set forth in SEQ ID NO: 282); $V_H$ CDR 2 (set forth in SEQ ID NO: 283); and $V_H$ CDR 3 (set forth in SEQ ID NO: 284). The light chain of Tremelimumab has a variable domain ($V_L$) with the sequence of amino acids set forth in SEQ ID NO: 36, encoded by the sequence of nucleotides set forth in SEQ ID NO: 35. The CDRs of the light chain include, $V_L$ CDR 1 (set forth in SEQ ID NO: 285); $V_L$ CDR 2 (set forth in SEQ ID NO: 286); and $V_L$ CDR 3 (set forth in SEQ ID NO: 287). When recombinantly produced, Tremelimumab is made up of four polypeptide chains; two identical heavy chains and two identical kappa light chains. Each heavy and light chain pair is linked through an interchain disulfide bond.

The anti-CTLA4 antibody in the combination therapy provided herein also include antigen-binding fragments of full-length Tremelimumab or variants thereof. An antigen-binding fragment minimally contains a variable heavy chain and/or variable light chain of Tremelimumab, or a sufficient portion thereof to form an antigen-binding site sufficient to bind CTLA4. Hence, the antibody can be any form of an antibody as long as, when it is produced or assembled into an antibody, it minimally contains a sufficient portion of the variable heavy chain and a sufficient portion of the variable light chain to immunospecifically bind CTLA4. For example, anti-CTLA4 antibodies for use in the combination therapy provided herein include antigen-binding fragments of Tremelimumab that minimally contain a variable heavy chain ($V_H$) with a sequence of amino acids set forth in SEQ ID NO: 34 and a variable light chain ($V_L$) with a sequence of amino acids set forth in SEQ ID NO: 36, or a sufficient portion of SEQ ID NO: 34 and SEQ ID NO: 36 to form an antigen-binding site to immunospecifically bind CTLA4. For example, examples of antibody fragments include, but are not limited to, Fab, Fab', F(ab')$_2$, single-chain Fv (scFv), Fv, dsFv, diabody, Fd and Fd' fragments.

The anti-CTLA4 antibody in the combination therapy provided herein also can include variants of Tremelimumab, or antigen-binding fragments thereof that include the variations. For example, an anti-CTLA4 antibody can include an antibody containing a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 34 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 36, where the variant antibody immunospecifically binds CTLA-4. The variation can be an amino acid replacement, insertion or deletion of amino acids. In some cases, only the heavy chain is varied. In other cases, only the light chain is varied. In still other cases, both the heavy chain and light chain are varied compared to the parental Tremelimumab antibody.

Variants of Tremelimumab are known in the art (see e.g., N294 in International Patent Publication No. WO 00/37504). In some examples, the antibody, purified from non-human sources, is modified to eliminate a glycosylation site, for example, to prevent changes in either the immunogenicity, pharmacokinetic, and/or effector functions resulting from non-human glycosylation. For example, in some variants, an asparagine can be replaced with glutamine (Q) (e.g., N294Q) to prevent glycosylation.

b. Anti-PD-1 and Anti-PD-L1 Therapies

The combination therapies provided herein, including compositions and methods and uses thereof, include therapeutic agents that inhibit PD-1 or PD-L1. Inhibitors include antibodies and fusion proteins, aptamers. Antibody, aptamer and fusion protein inhibitors that bind to PD-1 or PD-L1 and inhibit PD-1 inhibitory signaling are known. Exemplary fusion proteins include AMP-224 (also known as B7-DCIg), which is a PD-L2-Fc fusion soluble receptor described in International Patent Publication Nos. WO2010/027827 and WO201 1/066342.

Several antibodies, which bind PD-1 or PD-L1 and inhibit PD-1-inhibitory activity, have been described which have been used in anti-tumor immunotherapy. Anti-PD-1 antibodies include, but are not limited to, any of those described in U.S. Pat. Nos. 7,943,743, 8,008,449, 779,105, 8,735,553; U.S. Publication Nos. 2005/0180969 2007/0166281; International Patent Publication No. WO 2008/156712. Anti-PD-L1 antibodies include, but are not limited to, any of those described in U.S. Publ. Nos. 2013/0034559 and 2013/0045202; U.S. Pat. Nos. 7,943,743, 8,217,149, 8,679,767, and 8,779,108; and Intl. Publ. Nos. WO 2010/077634 and WO 2013/019906.

i. Anti-PD-1 Antibodies

In particular, anti-PD-1 antibodies include Nivolumab (also called BMS-936558; MDX-1106; or ONO-4538), MK-3475 (also known as Pembrolizumab or Lambrolizumab), Pidilizumab (or CT-011), and AMP-224. These anti-PD-1 antibodies have been involved in numerous clinical trials for the treatment of cancers, such as melanoma, NSCLC, RCC, hematologic malignancies, lymphomas, leukemias, pancreatic cancer, prostate cancer, lung cancer, and multiple myeloma.

(a) Nivolumab and Derivatives Thereof

An anti-PD-1 antibody for use in the combination therapy provided herein can include Nivolumab (also known as BMS-936558, MDX-1106, ONO-4538 or 5C4) or derivatives thereof, such as variants or antigen-binding fragments of Nivolumab. Nivolumab is a fully human IgG4 monoclonal antibody that specifically binds human PD-1 (see, e.g., antibody designated 5C4 in U.S. Pat. No. 8,008,449). The heavy chain of Nivolumab has a variable domain ($V_H$) with the sequence of amino acids set forth in SEQ ID NO: 54, encoded by the sequence of nucleotides set forth in SEQ ID NO: 53. The complementarity determining regions (CDRs) of the heavy chain include $V_H$ CDR 1 (set forth in SEQ ID NO: 57); $V_H$ CDR 2 (set forth in SEQ ID NO: 58); and $V_H$ CDR 3 (set forth in SEQ ID NO: 59). The light chain of Nivolumab has a variable domain ($V_L$) with the sequence of amino acids set forth in SEQ ID NO: 56, encoded by the sequence of nucleotides set forth in SEQ ID NO: 55. The CDRs of the light chain include, $V_L$ CDR 1 (set forth in SEQ ID NO: 60); $V_L$ CDR 2 (set forth in SEQ ID NO: 61); and $V_L$ CDR 3 (set forth in SEQ ID NO: 62). When recombinantly produced, Nivolumab is made up of four polypeptide chains; two identical heavy chains and two identical kappa light chains. Each heavy and light chain pair is linked through an interchain disulfide bond.

The anti-PD-1 antibody in the combination therapy provided herein also include antigen-binding fragments of full-length Nivolumab or variants thereof. An antigen-binding fragment minimally contains a variable heavy chain and/or variable light chain of Nivolumab, or a sufficient portion thereof to form an antigen-binding site sufficient to bind PD-1. Hence, the antibody can be any form of an antibody as long as, when it is produced or assembled into an antibody, it minimally contains a sufficient portion of the variable heavy chain and a sufficient portion of the variable light chain to immunospecifically bind PD-1. For example, anti-PD-1 antibodies for use in the combination therapy provided herein include antigen-binding fragments of Nivolumab that minimally contain a variable heavy chain ($V_H$) with a sequence of amino acids set forth in SEQ ID NO: 54 and a variable light chain ($V_L$) with a sequence of amino acids set forth in SEQ ID NO: 56, or a sufficient portion of SEQ ID NO: 54 and SEQ ID NO: 56 to form an antigen-binding site to immunospecifically bind PD-1. For example, examples of antibody fragments include, but are not limited to, Fab, Fab', F(ab')$_2$, single-chain Fv (scFv), Fv, dsFv, diabody, Fd and Fd' fragments.

The anti-PD-1 antibody in the combination therapy provided herein also can include variants of Nivolumab, or antigen-binding fragments thereof that include the variations. For example, an anti-PD-1 antibody can include an antibody containing a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the variable heavy chain set forth in SEQ ID NO: 54 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the variable light chain set forth in SEQ ID NO: 56, where the variant antibody immunospecifically binds PD-1. The variation can be an amino acid replacement, insertion or deletion of amino acids. In some cases, only the heavy chain is varied. In other cases, only the light chain is varied. In still other cases, both the heavy chain and light chain are varied compared to the parental Nivolumab antibody.

(b) MK-3475 and Derivatives Thereof

An anti-PD-1 antibody for use in the combination therapy provided herein can include MK-3475 (also called Pembrolizumab, Lambrolizumab or h409A11) or derivatives thereof, such as variants or antigen-binding fragments of MK-3475. MK-3475 is a humanized IgG4κ monoclonal antibody that specifically binds human PD-1 (see, e.g., antibody designated h409A11 in International Patent Publication No. WO 2008/156712). The complete heavy chain of MK-3475 has the sequence of amino acids set forth in SEQ ID NO: 64, encoded by a sequence of nucleotides set forth in SEQ ID NO: 63, and the complete light chain has the sequence of amino acids set forth in SEQ ID NO: 66, encoded by a sequence of nucleotides set forth in SEQ ID NO: 65. The heavy chain is composed of a variable domain (VH), with an amino acid sequence set forth in SEQ ID NO: 68, encoded by a sequence of nucleotides set forth in SEQ ID NO: 67). The light chain is composed of a variable domain (VL) with an amino acid sequence set forth in SEQ ID NO: 70, encoded by a sequence of nucleotides set forth in SEQ ID NO: 69) and a humanized kappa light constant region. When recombinantly produced, MK-3475 is made up of four polypeptide chains; two identical heavy chains of 447 amino acids each and two identical kappa light chains of 218 amino acids each. Each heavy and light chain pair is linked through an interchain disulfide bond.

The CDRs of MK-3475 include, VH CDR 1 (SEQ ID NO: 71); VH CDR 2 (SEQ ID NO: 72); VH CDR 3 (SEQ ID NO: 73); VL CDR 1 (SEQ ID NO: 74); VL CDR 2 (SEQ ID NO: 75); and VL CDR 3 (SEQ ID NO: 76).

The anti-PD-1 antibody in the combination therapy provided herein also can include variants of MK-3475. For example, an anti-PD-1 antibody can include an antibody containing a heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 64 and a light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 66. The variation can be an amino acid replacement, insertion or deletion of amino acids. In some cases, only the heavy chain is varied. In other cases, only the light chain is varied. In still other cases, both the heavy chain and light chain are varied compared to the parental MK-3475 antibody.

The anti-PD-1 antibody in the combination therapy provided herein also includes antigen-binding fragments of full-length MK-3475 or variants thereof. An antigen-binding fragment minimally contains a variable heavy chain and/or variable light chain of MK-3475, or a sufficient portion thereof to form an antigen-binding site sufficient to bind PD-1 Hence, the antibody can be any form of an antibody as long as, when it is produced or assembled into an antibody, it minimally contains a sufficient portion of the variable heavy chain and a sufficient portion of the variable light chain to immunospecifically bind PD-1. For example, anti-PD-1 antibodies for use in the combination therapy provided herein minimally contain a variable heavy chain ($V_H$) with a sequence of amino acids set forth in SEQ ID NO: 68 and a variable light chain ($V_L$) with a sequence of amino acids set forth in SEQ ID NO: 70, or a sufficient portion of SEQ ID NO: 68 and SEQ ID NO: 70 to form an antigen-binding site to immunospecifically bind PD-1. For example, examples of antibody fragments include, but are not limited to, Fab, Fab', F(ab')$_2$, single-chain Fv (scFv), Fv, dsFv, diabody, Fd and Fd' fragments.

(c) Pidilizumab and Derivatives Thereof

An anti-PD-1 antibody for use in the combination therapy provided herein can include Pidilizumab (also called hBAT-1 or CT-011) or derivatives thereof, such as variants or antigen-binding fragments of Pidilizumab. Pidilizumab is a humanized IgG1κ monoclonal antibody that was generated from a murine antibody (BAT), which was raised against B lymphoid cell membranes, and has been shown to elicit T-cell- and NK-cell-based activities. Pidilizumab binds human PD-1 (see, e.g., antibody designated BAT-1 R$κ_D$/RE$_C$ in US 2005/0180969). The complete heavy chain of Pidilizumab has the sequence of amino acids set forth in SEQ ID NO: 78, encoded by a sequence of nucleotides set forth in SEQ ID NO: 77, and the complete light chain has the sequence of amino acids set forth in SEQ ID NO: 80, encoded by a sequence of nucleotides set forth in SEQ ID NO: 79. The heavy chain is composed of a variable domain ($V_H$), with an amino acid sequence set forth in SEQ ID NO: 82, encoded by a sequence of nucleotides set forth in SEQ ID NO: 81. The light chain is composed of a variable domain ($V_L$) with an amino acid sequence set forth in SEQ ID NO: 84, encoded by a sequence of nucleic acids set forth in SEQ ID NO: 83, and a humanized kappa light constant region. When recombinantly produced, Pidilizumab is made up of four polypeptide chains; two identical heavy chains and two identical kappa light chains. Each heavy and light chain pair is linked through an interchain disulfide bond.

The CDRs of Pidilizumab include, $V_H$ CDR 1 (amino acid sequence set forth in SEQ ID NO: 85); $V_H$ CDR 2 (amino acid sequence set forth in SEQ ID NO: 86); $V_H$ CDR 3 (amino acid sequence set forth in SEQ ID NO: 87); $V_L$ CDR 1 (amino acid sequence set forth in SEQ ID NO: 88); $V_L$ CDR 2 (amino acid sequence set forth in SEQ ID NO: 89); and $V_L$ CDR 3 (amino acid sequence set forth in SEQ ID NO: 90).

The anti-PD-1 antibody in the combination therapy provided herein also can includes variants of Pidilizumab. For example, an anti-PD-1 antibody can include an antibody containing a heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 78 and a light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 80. The variation can be an amino acid replacement, insertion or deletion of amino acids. In some cases, only the heavy chain is varied. In other cases, only the light chain is varied. In still other cases, both the heavy chain and light chain are varied compared to the parental Pidilizumab antibody.

The anti-PD-1 antibody in the combination therapy provided herein also include antigen-binding fragments of full-length Pidilizumab or variants thereof. An antigen-binding fragment minimally contains a variable heavy chain and/or variable light chain of Pidilizumab, or a sufficient portion thereof to form an antigen-binding site sufficient to bind PD-1 Hence, the antibody can be any form of an antibody as long as, when it is produced or assembled into an antibody, it minimally contains a sufficient portion of the variable heavy chain and a sufficient portion of the variable light chain to immunospecifically bind PD-1. For example, anti-PD-1 antibodies for use in the combination therapy provided herein minimally contain a variable heavy chain ($V_H$) with a sequence of amino acids set forth in SEQ ID NO: 82 and a variable light chain ($V_L$) with a sequence of amino acids set forth in SEQ ID NO: 84, or a sufficient portion of SEQ ID NO: 82 and SEQ ID NO: 84 to form an antigen-binding site to immunospecifically bind PD-1. For example, examples of antibody fragments include, but are not limited to, Fab, Fab', F(ab')$_2$, single-chain Fv (scFv), Fv, dsFv, diabody, Fd and Fd' fragments.

ii. Anti-PD-L1 Antibodies

In particular, anti-PD-L1 (or anti-B7H1) antibodies include, but are not limited to, the antibodies called BMS-936559 (or MDX-1105), NIPDL3280A (or RG7446), and MEDI4736. These anti-PD-L1 antibodies have been involved in numerous clinical trials for the treatment of cancers, such as melanoma, NSCLC, ovarian cancer, RCC, and lung cancer.

(a) BMS-936559 and Derivatives Thereof

An anti-PD-L1 antibody for use in the combination therapy provided herein can include BMS-936559 (also known as MDX-1105 or 12A4) or derivatives thereof, such as variants or antigen-binding fragments of BMS-936559. BMS-936559 is a fully human IgG4 monoclonal antibody that specifically binds human PD-L1 (see, e.g., antibody designated 12A4 in U.S. Pat. No. 7,943,743). The heavy chain of BMS-936559 has a variable domain ($V_H$) with the sequence of amino acids set forth in SEQ ID NO: 92, encoded by the sequence of nucleotides set forth in SEQ ID NO: 91. The complementarity determining regions (CDRs) of the heavy chain include $V_H$ CDR 1 (set forth in SEQ ID NO: 95); $V_H$ CDR 2 (set forth in SEQ ID NO: 96); and $V_H$ CDR 3 (set forth in SEQ ID NO: 97). The light chain of BMS-936559 has a variable domain ($V_L$) with the sequence of amino acids set forth in SEQ ID NO: 94, encoded by the sequence of nucleotides set forth in SEQ ID NO: 93. The CDRs of the light chain include, $V_L$ CDR 1 (set forth in SEQ ID NO: 98); $V_L$ CDR 2 (set forth in SEQ ID NO: 99); and $V_L$ CDR 3 (set forth in SEQ ID NO: 100). When recombinantly produced, BMS-936559 is made up of four polypeptide chains; two identical heavy chains and two identical kappa light chains. Each heavy and light chain pair is linked through an interchain disulfide bond.

The anti-PD-L1 antibody in the combination therapy provided herein also include antigen-binding fragments of full-length BMS-936559 or variants thereof. An antigen-binding fragment minimally contains a variable heavy chain and/or variable light chain of BMS-936559, or a sufficient portion thereof to form an antigen-binding site sufficient to bind PD-L1. Hence, the antibody can be any form of an antibody as long as, when it is produced or assembled into an antibody, it minimally contains a sufficient portion of the variable heavy chain and a sufficient portion of the variable light chain to immunospecifically bind PD-L1. For example, anti-PD-L1 antibodies for use in the combination therapy provided herein include antigen-binding fragments of BMS-936559 that minimally contain a variable heavy chain ($V_H$) with a sequence of amino acids set forth in SEQ ID NO: 92 and a variable light chain ($V_L$) with a sequence of amino acids set forth in SEQ ID NO: 94, or a sufficient portion of SEQ ID NO: 92 and SEQ ID NO: 94 to form an antigen-binding site to immunospecifically bind PD-L1. For example, examples of antibody fragments include, but are not limited to, Fab, Fab', F(ab')$_2$, single-chain Fv (scFv), Fv, dsFv, diabody, Fd and Fd' fragments.

The anti-PD-L1 antibody in the combination therapy provided herein also can include variants of BMS-936559, or antigen-binding fragments thereof that include the variations. For example, an anti-PD-L1 antibody can include an antibody containing a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the variable heavy chain set forth in SEQ ID NO: 92 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the variable light chain set forth in SEQ ID NO: 94, where the variant antibody immunospecifically binds PD-L1. The variation can be an amino acid replacement, insertion or deletion of amino acids. In some cases, only the heavy chain is varied. In other cases, only the light chain is varied. In still other cases, both the heavy chain and light chain are varied compared to the parental BMS-936559 antibody.

(b) MPDL3280A and Derivatives Thereof

An anti-PD-L1 antibody for use in the combination therapy provided herein can include MPDL3280A (also known as RG7446) or derivatives thereof, such as variants or antigen-binding fragments of MPDL3280A. MPDL3280A is a fully human IgG4 monoclonal antibody that specifically binds human PD-L1 (see, e.g., U.S. Pat. No. 8,217,149 and International Patent Publication No. WO 2013/019906). MPDL3280A contains a heavy chain variable domain ($V_H$) with the sequence of amino acids set forth in SEQ ID NO: 114 and a light chain variable domain ($V_L$) with the sequence of amino acids set forth in SEQ ID NO: 115. The full-length antibody contains a heavy chain sequence of amino acids set forth in SEQ ID NO: 318 or 320 and a light chain sequence of amino acids set forth in SEQ ID NO: 319. The full-length antibody also is reported to contain a heavy chain sequence of amino acids set forth in SEQ ID NO: 112 and light chain sequence set forth in SEQ ID NO: 113 (see WO 2013019906). The complementarity determining regions (CDRs) of the heavy chain include $V_H$ CDR 1 (set forth in SEQ ID NO: 116); $V_H$ CDR 2 (set forth in SEQ ID NO: 117); and $V_H$ CDR 3 (set forth in SEQ ID NO: 118). The CDRs of the light chain include, $V_L$ CDR 1 (set forth in SEQ ID NO: 119); $V_L$ CDR 2 (set forth in SEQ ID NO: 120); and $V_L$ CDR 3 (set forth in SEQ ID NO: 121). When recombinantly produced, MPDL3280A is made up of four polypeptide chains; two identical heavy chains and two identical kappa light chains. Each heavy and light chain pair is linked through an interchain disulfide bond.

The anti-PD-L1 antibody in the combination therapy provided herein also can include variants of MPDL3280A, or antigen-binding fragments thereof that include the variations. For example, an anti-PD-L1 antibody can include an antibody containing a heavy chain that has a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 112, 318 or 320 and a light chain that has a sequence of amino acids that has a sequence identity of at least 85%, 86%, 87%, 88%, 89%, 90%, 91%, 92%, 93%, 94%, 95%, 96%, 97%, 98%, or 99% to the light chain set forth in SEQ ID NO: 113 or 319, where the variant antibody immunospecifically binds PD-L1. The variation can be an amino acid replacement, insertion or deletion of amino acids. In some cases, only the heavy chain is varied. In other cases, only the light chain is varied. In still other cases, both the heavy chain and light chain are varied compared to the parental MPDL3280A antibody.

The anti-PD-L1 antibody in the combination therapy provided herein also include antigen-binding fragments of full-length MPDL3280A or variants thereof. An antigen-binding fragment minimally contains a variable heavy chain and/or variable light chain of MPDL3280A, or a sufficient portion thereof to form an antigen-binding site sufficient to bind PD-L1. Hence, the antibody can be any form of an antibody as long as, when it is produced or assembled into an antibody, it minimally contains a sufficient portion of the variable heavy chain and a sufficient portion of the variable light chain to immunospecifically bind PD-L1. For example, anti-PD-L1 antibodies for use in the combination therapy provided herein include antigen-binding fragments of MPDL3280A that minimally contain a variable heavy chain ($V_H$) with a sequence of amino acids set forth in SEQ ID NO: 114 and a variable light chain ($V_L$) with a sequence of amino acids set forth in SEQ ID NO: 115, or a sufficient portion of SEQ ID NO: 114 and SEQ ID NO: 115 to form an antigen-binding site to immunospecifically bind PD-L1. For example, examples of antibody fragments include, but are not limited to, Fab, Fab', F(ab')$_2$, single-chain Fv (scFv), Fv, dsFv, diabody, Fd and Fd' fragments.

(c) MEDI4736 and Derivatives Thereof

An anti-PD-L1 antibody for use in the combination therapy provided herein can include MEDI4736 or derivatives thereof, such as variants or antigen-binding fragments of MEDI4736. MEDI4736 is a fully human IgG1 monoclonal antibody that specifically binds human PD-L1 (see, e.g., antibody designated 2.7A4OPT in U.S. Patent Publ. No. 2013/0034559). The heavy chain of MEDI4736 has a variable domain ($V_H$) with the sequence of amino acids set forth in SEQ ID NO: 102, encoded by the sequence of nucleotides set forth in SEQ ID NO: 101. The complementarity determining regions (CDRs) of the heavy chain include $V_H$ CDR 1 (set forth in SEQ ID NO: 105); $V_H$ CDR 2 (set forth in SEQ ID NO: 106); and $V_H$ CDR 3 (set forth in SEQ ID NO: 107). The light chain of MEDI4736 has a variable domain ($V_L$) with the sequence of amino acids set forth in SEQ ID NO: 104, encoded by the sequence of nucleotides set forth in SEQ ID NO: 103. The CDRs of the light chain include, $V_L$ CDR 1 (set forth in SEQ ID NO: 108); $V_L$ CDR 2 (set forth in SEQ ID NO: 109); and $V_L$ CDR 3 (set forth in SEQ ID NO: 110). When recombinantly produced, MEDI4736 is made up of four polypeptide chains; two identical heavy chains and two identical kappa light chains. Each heavy and light chain pair is linked through an interchain disulfide bond.

The anti-PD-L1 antibody in the combination therapy provided herein also includes antigen-binding fragments of full-length MEDI4736 or variants thereof. An antigen-binding fragment minimally contains a variable heavy chain and/or variable light chain of MEDI4736, or a sufficient portion thereof to form an antigen-binding site sufficient to bind PD-L1. Hence, the antibody can be any form of an antibody as long as, when it is produced or assembled into an antibody, it minimally contains a sufficient portion of the variable heavy chain and a sufficient portion of the variable light chain to immunospecifically bind PD-L1. For example, anti-PD-L1 antibodies for use in the combination therapy provided herein include antigen-binding fragments of MEDI4736 that minimally contain a variable heavy chain ($V_H$) with a sequence of amino acids set forth in SEQ ID NO: 102 and a variable light chain ($V_L$) with a sequence of amino acids set forth in SEQ ID NO: 104, or a sufficient portion of SEQ ID NO: 102 and SEQ ID NO: 104 to form an antigen-binding site to immunospecifically bind PD-L1. For example, examples of antibody fragments include, but are not limited to, Fab, Fab', F(ab')$_2$, single-chain Fv (scFv), Fv, dsFv, diabody, Fd and Fd' fragments.

The anti-PD-L1 antibody in the combination therapy provided herein also can include variants of MEDI4736, or antigen-binding fragments thereof that include the variations. For example, an anti-PD-L1 antibody can include an antibody containing a variable heavy chain that has a sequence of amino acids that has a sequence identity of at least 85%, 86%, 87%, 88%, 89%, 90%, 91%, 92%, 93%, 94%, 95%, 96%, 97%, 98%, or 99% to the variable heavy chain set forth in SEQ ID NO: 102 and a variable light chain that has a sequence of amino acids that has a sequence identity of at least 85%, 86%, 87%, 88%, 89%, 90%, 91%, 92%, 93%, 94%, 95%, 96%, 97%, 98%, or 99% to the variable light chain set forth in SEQ ID NO: 104, where the variant antibody immunospecifically binds PD-L1. The variation can be an amino acid replacement, insertion or deletion of amino acids. In some cases, only the heavy chain is varied. In other cases, only the light chain is varied. In still other cases, both the heavy chain and light chain are varied compared to the parental MEDI4736 antibody.

c. Other Immunomodulatory Therapies

Other immunomodulatory agents which are contemplated for use in the combinations, methods, and uses provided herein include inhibitory agents targeted against the inhibitory receptors lymphocyte-activation gene 3 (LAG3) and T cell membrane protein 3 (TIM3), inhibitory ligands such as PD-L2 (or B7-H2), B7-H3, B7-H4, and CD25, and the immunosuppressive enzyme Indoleamine 2,3-dioxygenase (IDO). Agents directed against LAG3 (e.g., fusion protein IMP321 and multiple mAbs) and anti B7-H3 antibodies (e.g., MGA271) have been characterized and are in use in clinical trials. Antibodies or inhibitory agents of B7-H4 and TIM3 are in preclinical development (Pardoll, Nat Rev Cancer. 2012 Mar. 22; 12(4):252-264). Any one of more of these agents can be included in any of the combinations provided herein.

In addition to inhibitory antibodies that target and inhibit immune checkpoint proteins, agonistic antibodies, which are capable of stimulating an immune response by binding its target protein/receptor, are contemplated for use in the combinations, methods, and uses provided herein. For example, Urelumab (also known as BMS-663513 and anti-4-1BB) is an agonistic humanized monoclonal antibody targeting the CD137 co-receptor, that is a member of the tumor necrosis factor (TNF)/nerve growth factor (NGF) family of receptors and is expressed on dendritic cells, follicular dendritic cells, natural killer cells, granulocytes and cells of blood vessel walls at sites of inflammation, with immunostimulatory properties. Urelumab specifically binds to and activates CD137-expressing immune cells, stimulating an immune response, in particular a cytotoxic T cell response, which can be mounted against tumor cells when administered as a part of a combination therapy provided herein (see, e.g., Vinay et al., (2012) *Mol Cancer Ther.* 11(5):1062-1070). Other 4-1BB agonists also can be included in the combinations provided herein, such as any described by Snell et al. In Immunol Rev. 244:197-217 (2011). OX40 (also known as CD134) is another immunostimulatory receptor, of the TNF family, which can be targeted by incorporating OX40 agonists, such as those described by Weinberg et al. In *Immunol Rev.* 244(1):218-231 (2011), into the combinations provided herein. Aptamer ligands which bind and stimulate 4-1BB or OX40 signaling also have been described (Gilboa et al., *Clin Cancer Res.* 19(5):1054-1062) and are contemplated for inclusion in the combination therapies provided herein.

2. Hyaluronan-Degrading Enzymes and Polymer-Conjugated Hyaluronan-Degrading Enzymes The combination therapy, including combinations and methods and use thereof, provided herein contains a hyaluronan-degrading enzyme, such as a polymer-conjugated hyaluronan-degrading enzyme. The hyaluronan-degrading enzyme is one that can be administered so that it reaches its target, and in particular reaches a tumor cell containing elevated pericellular HA. For example, the hyaluronan-degrading enzyme can be administered by continuous infusion or injected locally, can be modified with a polymer, or is one that is aglycosylated or is modified such that it is aglycosylated or has decreased glycosylation. In one example, the provided compositions and combinations contain a hyaluronan-degrading enzyme, in particular a hyaluronidase, such as a soluble hyaluronidase (e.g., a PH20 or truncated PH20), that has been modified by conjugation to one or more polymeric molecules (polymer), typically to increase the half-life of the hyaluronan-degrading enzyme, for example, to promote prolonged/sustained treatment effects in a subject.

Hyaluronan is a component of the extracellular matrix and a major constituent of the interstitial barrier. By catalyzing the hydrolysis of hyaluronan, hyaluronan-degrading enzymes lower the viscosity of hyaluronan, thereby increasing tissue permeability and increasing the absorption rate of fluids administered parenterally. Hyaluronan-degrading enzymes, such as hyaluronidase, interfere with and degrade hyaluronic acid (HA). Treatment with hyaluronan-degrading enzymes reduces the hyaluronan such that the tissue deflates, the blood vessels expand, and more blood can flow through the site. As such, hyaluronan-degrading enzymes, such as hyaluronidases, have been used, for example, as spreading or dispersing agents in conjunction with other agents, drugs and proteins to enhance their dispersion and delivery.

Hyaluronan-degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating β-1→4 and β-1→3 glycosidic bonds. Hyaluronan chains can reach about 25,000 disaccharide repeats or more in length and polymers of hyaluronan can range in size from about 5,000 to 20,000,000 Da in vivo. By catalyzing the hydrolysis of hyaluronan, a major constituent of the interstitial barrier, hyaluronan-degrading enzymes lower the viscosity of hyaluronan, thereby increasing tissue permeability.

Accordingly, hyaluronan-degrading enzymes for the combinations, uses and methods provided include any enzyme having the ability to catalyze the cleavage of a hyaluronan disaccharide chain or polymer. In some examples the hyaluronan-degrading enzyme cleaves the β-1→4 glycosidic bond in the hyaluronan chain or polymer. In other examples, the hyaluronan-degrading enzyme catalyze the cleavage of the β-1→3 glycosidic bond in the hyaluronan chain or polymer.

Hyaluronan-degrading enzymes include hyaluronidases, as well as other enzymes such as chondroitinases and lyases that have the ability to cleave hyaluronan. Further, hyaluronan-degrading enzymes also include soluble forms thereof that can be expressed and secreted from cells. As described below, hyaluronan-degrading enzymes exist in membrane-bound or soluble forms that are secreted from cells. For purposes herein, soluble hyaluronan-degrading enzymes are provided for use in the combinations, methods and uses herein. Thus, where hyaluronan-degrading enzymes include a glycosylphosphatidylinositol (GPI) anchor and/or are otherwise membrane-anchored or insoluble, such hyaluronan-degrading enzymes can be provided in soluble form by truncation or deletion of all or a portion of the GPI anchor to render the enzyme secreted and soluble. Thus, hyaluronan-degrading enzymes include truncated variants, e.g., truncated to remove all or a portion of a GPI anchor. Examples of such soluble hyaluronidases include soluble PH20 hyaluronidases, such as any set forth in U.S. Pat. No. 7,767,429; U.S. Publication Nos. US20040268425 or US20100143457, see also exemplary soluble human PH20 hyaluronidases set forth in any of SEQ ID NOS: 123-158).

Hyaluronan-degrading enzymes provided herein also include variants of any hyaluronan-degrading enzyme, such as any hyaluronidase or soluble hyaluronidase, for example a PH20, that is known to one of skill in the art or described herein. For example, hyaluronan-degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan-degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan-degrading enzyme not containing the variation (as measured by in vitro and/or in vivo assays well-known in the art and described herein). For example, exemplary hyaluronan-degrading enzymes, including those that can be conjugated to a polymer, are any that exhibit at least or about 60%, 70%, 80%, 90%, 91%, 92%, 93%, 94%, 95%, 96%, 97%, 98%, 99% or more sequence identity to any of SEQ ID NOS: 122-170. As discussed below, examples of such PH20 variants are known and are described in U.S. Publ. No. US2013-0302275.

Various forms of hyaluronan-degrading enzymes, including hyaluronidases have been prepared and approved for therapeutic use in subjects, including humans. For example, animal-derived hyaluronidase preparations include Vitrase® (ISTA Pharmaceuticals), a purified ovine testicular hyaluronidase, Amphadase® (Amphastar Pharmaceuticals), a bovine testicular hyaluronidase and Hydase™ (Prima Pharm Inc.), a bovine testicular hyaluronidase. Hylenex® (Halozyme Therapeutics) is a human recombinant hyaluronidase produced by genetically engineered Chinese Hamster Ovary (CHO) cells containing nucleic acid encoding soluble forms of PH20, designated rHuPH20 (see e.g., U.S. Publication Nos. US20040268425; U.S. Pat. No. 7,767, 429). It is understood that any hyaluronidase preparation can be used in the combinations, methods and uses provided herein (see, e.g., U.S. Pat. Nos. 2,488,564, 2,488,565, 2,676, 139, 2,795,529, 2,806,815, 2,808,362, 5,747,027 and 5,827, 721 and International PCT Publication No. WO2005/ 118799; U.S. Publication Nos. US20040268425; U.S. Pat. No. 7,767,429; or any provided herein).

A non-limiting description of exemplary hyaluronan-degrading enzymes, such as hyaluronidase enzymes or soluble hyaluronidase enzyme, for example PH20, for use in the combinations and methods provided herein are described below. Generally, such hyaluronan-degrading enzymes include those that are conjugated to a polymer.

a. Hyaluronidases

Hyaluronidases are members of a large family of hyaluronan-degrading enzymes. There are three general classes of hyaluronidases: mammalian-type hyaluronidases, bacterial hyaluronidases and hyaluronidases from leeches, other parasites and crustaceans. Other hyaluronidases are known such as yellow jacket wasp (SEQ ID NOS: 171 and 172), honey bee (SEQ ID NO: 173), white-face hornet (SEQ ID NO: 174) and paper wasp (SEQ ID NO: 175). Any of such enzymes can be used in the compositions, combinations and methods provided herein.

i. Mammalian-type hyaluronidases Mammalian-type hyaluronidases (EC 3.2.1.35) are endo-β-N-acetyl-hexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, from cows (bovine) (SEQ ID NOS: 163, 164, and 176-178, and nucleic acid molecules set forth in SEQ ID NOS: 181-183), sheep (*Ovis aries*) (SEQ ID NO: 184-187, nucleic acid molecules set forth in SEQ ID NOS: 188-190), pig (SEQ ID NOS: 191-192), mouse (SEQ ID NOS: 165, 193-196), rat (SEQ ID NOS: 166, 198-201), rabbit (SEQ ID NO: 167, 203), orangutan (SEQ ID NO: 205), cynomolgus monkey (SEQ ID NO: 162, 206), guinea pig (SEQ ID NO: 168, 197), chimpanzee (SEQ ID NO: 159, 160, and 204), rhesus monkey (SEQ ID NO: 161, 202), fox (SEQ ID NO: 169, 170) and human hyaluronidases (SEQ ID NOS: 122, 217-221). The above hyaluronidases include PH20 hyaluronidases. Also, BH55 hyaluronidase is of this type as described in U.S. Pat. Nos. 5,747,027 and 5,827,721. Exemplary hyaluronidases in the compositions, combinations and methods provided herein are soluble hyaluronidases.

Mammalian hyaluronidases can be further subdivided into those that are neutral active, predominantly found in testes extracts, and acid active, predominantly found in organs such as the liver. Exemplary neutral active hyaluronidases include PH20, including, but not limited to, PH20 derived from different species such as ovine (SEQ ID NOS: 185-187), bovine (SEQ ID NO: 177, 178) and human (SEQ ID NO: 217). Human PH20 (also known as SPAM1 or sperm surface protein PH20), is generally attached to the plasma membrane via a glycosylphosphatidyl inositol (GPI) anchor. It is naturally involved in sperm-egg adhesion and aids penetration by sperm of the layer of cumulus cells by digesting hyaluronic acid.

Besides human PH20 (or SPAM1), five hyaluronidase-like genes have been identified in the human genome, HYAL1, HYAL2, HYAL3, HYAL4 and HYALP1. HYALP1 is a pseudogene, and HYAL3 (SEQ ID NO: 220) has not been shown to possess enzyme activity toward any known substrates. HYAL4 (precursor polypeptide set forth in SEQ ID NO: 221) is a chondroitinase and exhibits little activity towards hyaluronan. HYAL1 (precursor polypeptide set forth in SEQ ID NO: 218) is the prototypical acid-active enzyme and PH20 (precursor polypeptide set forth in SEQ ID NO: 217) is the prototypical neutral-active enzyme. Acid-active hyaluronidases, such as HYAL1 and HYAL2 (precursor polypeptide set forth in SEQ ID NO: 219) generally lack catalytic activity at neutral pH (i.e., pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosylphosphatidyl inositol (GPI) anchor such as human HYAL2 and human PH20 (Danilkovitch-Miagkova et al. (2003) *Proc Natl Acad Sci USA* 100(8):4580-4585), and those which are generally soluble such as human HYAL1 (Frost et al. (1997) *Biochem Biophys Res Commun.* 236(1): 10-15).

PH20

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. It has both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 also appears to be a receptor for HA-induced cell signaling, and a receptor for the zona pellucida surrounding the oocyte.

Exemplary PH20 proteins, including precursor and mature forms, include, but are not limited to, human (precursor polypeptide set forth in SEQ ID NO: 217, mature polypeptide set forth in SEQ ID NO: 122), chimpanzee (SEQ ID NO: 159, 160, and 204), Rhesus monkey (SEQ ID NO: 161, 202) bovine (SEQ ID NOS: 164,163, 177, 178), rabbit (SEQ ID NO: 167, 203), ovine PH20 (SEQ ID NOS: 185-187), Cynomolgus monkey (SEQ ID NO: 162, 206), guinea pig (SEQ ID NO: 168, 197), rat (SEQ ID NO: 166, 201), mouse (SEQ ID NO: 165, 196) and fox (SEQ ID NO: 169, 170) PH20 polypeptides.

Bovine PH20 is a 553 amino acid precursor polypeptide (SEQ ID NO: 177). Alignment of bovine PH20 with the human PH20 shows only weak homology, with multiple gaps existing from amino acid 470 through to the respective carboxy termini due to the absence of a GPI anchor in the bovine polypeptide (see e.g., Frost (2007) *Expert Opin. Drug. Deliv.* 4:427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-636). This unique feature of bovine hyaluronidase has permitted the use of the soluble bovine testes hyaluronidase enzyme as an extract for clinical use (Wydase®, Hyalase®).

The human PH20 mRNA transcript is normally translated to generate a 509 amino acid precursor polypeptide (SEQ ID NO: 217) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 therefore, is a 474 amino acid polypeptide set forth in SEQ ID NO: 122. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO: 217. Thus, a 474 amino acid GPI-anchored mature polypeptide with an amino acid sequence, set forth in SEQ ID NO: 122, is produced.

Human PH20 exhibits hyaluronidase activity at neutral and acid pH. In one aspect, human PH20 is the prototypical neutral-active hyaluronidase that is generally locked to the plasma membrane via a GPI anchor. In another aspect, PH20 is expressed on the inner acrosomal membrane where it has hyaluronidase activity at neutral and acid pH. It appears that PH20 contains two catalytic sites at distinct regions of the polypeptide: the Peptide 1 and Peptide 3 regions (Cherr et al., (2001) *Matrix Biology* 20:515-525). Evidence indicates that the Peptide 1 region of PH20, which corresponds to amino acid positions 107-137 of the mature polypeptide set forth in SEQ ID NO: 122 and positions 142-172 of the precursor polypeptide set forth in SEQ ID NO: 217, is required for enzyme activity at neutral pH. Amino acids at positions 111 and 113 (corresponding to the mature PH20 polypeptide set forth in SEQ ID NO: 122) within this region appear to be important for activity, as mutagenesis by amino acid replacement results in PH20 polypeptides with 3% hyaluronidase activity or undetectable hyaluronidase activity, respectively, compared to the wild-type PH20 (Arming et al., (1997) *Eur. J. Biochem.* 247:810-814).

The Peptide 3 region, which corresponds to amino acid positions 242-262 of the mature polypeptide set forth in SEQ ID NO: 122, and positions 277-297 of the precursor polypeptide set forth in SEQ ID NO: 217, appears to be important for enzyme activity at acidic pH. Within this region, amino acids at positions 249 and 252 of the mature PH20 polypeptide appear to be essential for activity, and mutagenesis of either one results in a polypeptide essentially devoid of activity (Arming et al., (1997) *Eur. J. Biochem.* 247:810-814).

In addition to the catalytic sites, PH20 also contains a hyaluronan-binding site. Experimental evidence indicates that this site is located in the Peptide 2 region, which corresponds to amino acid positions 205-235 of the precursor polypeptide set forth in SEQ ID NO: 217 and positions 170-200 of the mature polypeptide set forth in SEQ ID NO: 122. This region is highly conserved among hyaluronidases and is similar to the heparin binding motif. Mutation of the arginine residue at position 176 (corresponding to the mature PH20 polypeptide set forth in SEQ ID NO: 122) to a glycine results in a polypeptide with only about 1% of the hyaluronidase activity of the wild type polypeptide (Arming et al., (1997) *Eur. J. Biochem.* 247:810-814).

There are seven potential glycosylation sites, including N- and O-linked glycosylation sites, in human PH20 at N82, N166, N235, N254, N368, N393 and S490 of the polypeptide exemplified in SEQ ID NO: 217. Because amino acids 36 to 464 of SEQ ID NO: 217 appear to contain the minimally active human PH20 hyaluronidase domain, the glycosylation site at S490 is not required for proper hyaluronidase activity. There are six disulfide bonds in human PH20. Two disulfide bonds between the cysteine residues C60 and C351 and between C224 and C238 of the polypeptide exemplified in SEQ ID NO: 217 (corresponding to residues C25 and C316, and C189 and C203 of the mature polypeptide set forth in SEQ ID NO: 122, respectively). A further four disulfide bonds are formed between the cysteine residues C376 and C387; between C381 and C435; between C437 and C443; and between C458 and C464 of the polypeptide exemplified in SEQ ID NO: 217 (corresponding to residues C341 and C352; between C346 and C400; between C402 and C408; and between C423 and C429 of the mature polypeptide set forth in SEQ ID NO: 122, respectively).

ii. Bacterial Hyaluronidase

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for use in the compositions, combinations and methods provided include, but are not limited to, hyaluronan-degrading enzymes in microorganisms, including strains of *Arthrobacter, Bdellovibrio, Clostridium, Micrococcus, Streptococcus, Peptococcus, Propionibacterium, Bacteroides*, and *Streptomyces*. Particular examples of such strains and enzymes include, but are not limited to *Arthrobacter* sp. (strain FB24) (SEQ ID NO: 222), *Bdellovibrio bacteriovorus* (SEQ ID NO: 223), *Propionibacterium acnes* (SEQ ID NO: 224), *Streptococcus agalactiae* ((SEQ ID NO: 225); 18RS21 (SEQ ID NO: 226); serotype Ia (SEQ ID NO: 227); and serotype III (SEQ ID NO: 228)), *Staphylococcus aureus* (strain COL (SEQ ID NO: 229); strain MRSA252 (SEQ ID NOS: 230, 231); strain MSSA476 (SEQ ID NO: 232); strain NCTC 8325 (SEQ ID NO: 233); strain bovine RF122 (SEQ ID NOS: 234, 235); and strain USA300 (SEQ ID NO: 236)), *Streptococcus pneumoniae* ((SEQ ID NO: 237); strain ATCC BAA-255/R6 (SEQ ID NO: 238); and serotype 2, strain D39/NCTC 7466 (SEQ ID NO: 239)), *Streptococcus pyogenes* (serotype M1 (SEQ ID NO: 240); serotype M2, strain MGAS10270 (SEQ ID NO: 241); serotype M4, strain MGAS10750 (SEQ ID NO: 242); serotype M6 (SEQ ID NO: 243); serotype M12, strain MGAS2096 (SEQ ID NOS: 244, 245); serotype M12, strain MGAS9429 (SEQ ID NO: 246); and serotype M28 (SEQ ID NO: 247)); *Streptococcus suis* (SEQ ID NOS: 248-250); *Vibrio fischeri* (strain ATCC 700601/ES114 (SEQ ID NO: 251)), and the *Streptomyces* hyaluronolyticus hyaluronidase enzyme, which is specific for hyaluronic acid and does not cleave chondroitin or chondroitin sulfate (Ohya, T. and Kaneko, Y. (1970) *Biochim. Biophys. Acta* 198:607).

iii. Hyaluronidases from Leeches, Other Parasites and Crustaceans

Hyaluronidases from leeches, other parasites, and crustaceans (EC 3.2.1.36) are endo-β-glucuronidases that generate tetra- and hexasaccharide end-products. These enzymes catalyze hydrolysis of 1→3-linkages between β-D-glucuronate and N-acetyl-D-glucosamine residues in hyaluronate. Exemplary hyaluronidases from leeches include, but are not limited to, hyaluronidase from Hirudinidae (e.g., *Hirudo medicinalis*), Erpobdellidae (e.g., *Nephelopsis obscura* and *Erpobdella punctata*), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol Biol.* 124(3):319-26). An exemplary hyaluronidase from bacteria that has the same mechanism of action as the leech hyaluronidase is that from the cyanobacteria, *Synechococcus* sp.; strain RCC307 (SEQ ID NO: 252).

b. Other Hyaluronan-Degrading Enzymes

In addition to the hyaluronidase family, other hyaluronan-degrading enzymes can be used in the compositions, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem.* 243(7):1523-1535; Yang et al. (1985) *J. Biol. Chem.* 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J. Biol. Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272:9123-9130). Exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO: 253 (Sato et al. (1994) *Appl. Microbiol. Biotechnol.* 41(1): 39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS: 254 and 255, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133).

c. Soluble Hyaluronan-Degrading Enzymes (e.g., Soluble PH20)

Provided in the compositions, combinations, uses and methods herein are soluble hyaluronan-degrading enzymes, including soluble hyaluronidases. Soluble hyaluronan-degrading enzymes include any hyaluronan-degrading enzymes that are secreted from cells (e.g., CHO cell) upon expression and exist in soluble form. Such enzymes include, but are not limited to, soluble hyaluronidases, including non-human animal soluble hyaluronidases, and human hyaluronidases, such as Hyal1, bovine PH20, ovine PH20, and any hyaluronan-degrading enzymes that have been modified to be soluble, and allelic variants thereof and other variants thereof. For example, hyaluronan-degrading enzymes that contain a GPI anchor can be made soluble by C-terminal truncation of and removal of all or a portion of the GPI anchor. In one example, a soluble hyaluronidase is a C-terminally truncated human PH20 in which the human hyaluronidase PH20, which is normally membrane anchored via a GPI anchor, is truncated and lacks all or a portion of the GPI anchor at the C-terminus.

Soluble hyaluronan-degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan-degrading enzyme for use in the compositions, combinations and methods herein is a soluble neutral active hyaluronidase.

Such soluble forms include truncated forms thereof lacking all or a portion of the C-terminal GPI anchor, so long as the hyaluronidase is soluble (secreted upon expression) and retains hyaluronidase activity (see, e.g., also U.S. Pat. Nos. 8,431,380 and 7,767,429). Such forms also typically are mature forms that, when expressed in a cell, lack the signal peptide. Exemplary hyaluronidases include soluble forms of a PH20 from any species, such as a soluble form of a PH20 of any of SEQ ID NOS: 122, 159, 160, 161-170, 177, 178, 185-187, 196, 197, 203, 206, 201, 202, 204, and 217. Also included among soluble hyaluronidases are soluble forms of variants of any of the PH20s from any species set forth in SEQ ID NOS: 122, 159, 160, 161-170, 177, 178, 185-187, 196, 197, 203, 206, 201, 202, 204, and 217, or truncated forms thereof, that exhibit hyaluronidase activity. Variants include polypeptides having 60%, 70%, 80%, 90%, 91%, 92%, 93%, 94%, 95%, 96%, 97%, 98%, 99% or more sequence identity to any of SEQ ID NOS: 122, 159, 160, 161-170, 177, 178, 185-187, 196, 197, 203, 206, 201, 202, 204, and 217, and mature (e.g., lacking the signal sequence) or soluble truncated forms thereof. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113 and 176 (corresponding to residues in the mature PH20 polypeptide set forth in SEQ ID NO: 122) of a human PH20 polypeptide, or soluble form thereof, are generally invariant and are not altered. Other residues that confer glycosylation and formation of disulfide bonds required for proper folding also can be invariant. Modified forms of the soluble PH20 enzymes also are known (see, Publication No. US-2013-0302275), which include PH20 enzymes that have improved stability under denaturing conditions, such as those that include replacement of the residue corresponding to 204 (of the full-length human PH20) with proline (P).

In some instances, the soluble hyaluronan-degrading enzyme is normally GPI-anchored (such as, for example, human PH20) and is rendered soluble by truncation at the C-terminus. Such truncation can remove all of the GPI anchor attachment signal sequence, or can remove only some of the GPI anchor attachment signal sequence. The resulting polypeptide, however, is soluble. In instances where the soluble hyaluronan-degrading enzyme retains a portion of the GPI anchor attachment signal sequence, 1, 2, 3, 4, 5, 6, 7 or more amino acid residues in the GPI-anchor attachment signal sequence can be retained, provided the polypeptide is soluble. Polypeptides containing one or more amino acids of the GPI anchor are termed extended soluble hyaluronan-degrading enzymes. One of skill in the art can determine whether a polypeptide is GPI-anchored using methods well-known in the art. Such methods include, but are not limited to, using known algorithms to predict the presence and location of the GPI-anchor attachment signal sequence and w-site, and performing solubility analyses before and after digestion with phosphatidylinositol-specific phospholipase C (PI-PLC) or D (PI-PLD).

Extended soluble hyaluronan-degrading enzymes can be produced by making C-terminal truncations to any naturally GPI-anchored hyaluronan-degrading enzyme such that the resulting polypeptide is soluble and contains one or more amino acid residues from the GPI-anchor attachment signal sequence (see, e.g., U.S. Published Pat. Appl. No. US20100143457). Exemplary extended soluble hyaluronan-degrading enzymes that are C-terminally truncated but retain a portion of the GPI anchor attachment signal sequence include, but are not limited to, extended soluble PH20 (esPH20) polypeptides of primate origin, such as, for example, human and chimpanzee esPH20 polypeptides. For example, the esPH20 polypeptides can be made by C-terminal truncation of any of the mature or precursor polypeptides set forth in SEQ ID NOS: 122, 179, 180, or 204, or 217, or other variants thereof, including active fragment thereof, wherein the resulting polypeptide is soluble and retains one or more amino acid residues from the GPI-anchor attachment signal sequence. Variants include polypeptides having 60%, 70%, 80%, 90%, 91%, 92%, 93%, 94%, 95% or more sequence identity to any of SEQ ID NOS: 122, 179, 180, or 204, or 217 that retain hyaluronidase activity. The esPH20 polypeptides provided herein can be C-terminally truncated by 1, 2, 3, 4, 5, 6, 7, 8, 9, 10 or more amino acids compared to the wild type polypeptide, such as a polypeptide with a sequence set forth in SEQ ID NOS: 122, 179, 180, or 204, or 217, provided the resulting esPH20 polypeptide is soluble and retains 1 or more amino acid residues from the GPI-anchor attachment signal sequence.

Typically, for use in the compositions, combinations and methods herein, a soluble human hyaluronan-degrading enzyme, such as a soluble human PH20, is used. Although hyaluronan-degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan-degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan-degrading enzymes, are provided elsewhere herein and are well-known in the art.

i. Soluble Human PH20

Soluble human PH20 is an example of a soluble hyaluronidase. Soluble forms of recombinant human PH20 have been produced and can be used in the compositions, combinations and methods described herein. The production of such soluble forms of PH20 is described in U.S. Published Patent Application Nos. US20040268425; US20050260186, US20060104968, US20100143457 and International PCT Publication No. WO2009111066. For example, soluble PH20 polypeptides, include C-terminally truncated variant polypeptides that include a sequence of amino acids in SEQ ID NO: 217 or 122, or have at least 91%, 92%, 93%, 94%, 95%, 96%, 97%, or 98% sequence identity to a sequence of amino acids included in SEQ ID NO: 217 or 122, retain hyaluronidase activity and are soluble. Included among these polypeptides are soluble PH20 polypeptides that completely lack all or a portion of the GPI-anchor attachment signal sequence.

Also included are extended soluble PH20 (esPH20) polypeptides that contain at least one amino acid of the GPI anchor. Thus, instead of having a GPI-anchor covalently attached to the C-terminus of the protein in the ER and being anchored to the extracellular leaflet of the plasma membrane, these polypeptides are secreted and are soluble. C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NO: 217 or 122, or allelic or species variants or other variants thereof.

Soluble forms of human PH20 generally include those that contain amino acids 36-464 set forth in SEQ ID NO: 217. For example, soluble forms include, but are not limited to, C-terminal truncated polypeptides of human PH20 set forth in SEQ ID NO: 217 having a C-terminal amino acid residue 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO: 217, mature forms thereof, or polypeptides that exhibit at least 85% identity thereto. For example, when expressed in mammalian cells, the 35 amino acid N-terminal signal sequence is cleaved during processing, and the mature form of the protein is produced and can be secreted. Thus, the mature soluble polypeptides contain amino acids 36 to 467, 468, 469, 470, 471, 472, 473, 474, 475, 476, 477, 478, 479, 480, 481, 482 and 483 of SEQ ID NO: 217. Table 4 provides non-limiting examples of exemplary C-terminally truncated soluble PH20 polypeptides, including precursor and mature forms thereof. In Table 4 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 4 for comparison. In particular, exemplary soluble hyaluronidases are soluble human PH20 polypeptides that are 442, 443, 444, 445, 446 or 447 amino acids in length, such as those set forth in any of SEQ ID NOS: 123-128, or allelic or species variants or other variants thereof.

TABLE 4

Exemplary C-terminally truncated PH20 polypeptides

| Precursor | | | Mature | | |
|---|---|---|---|---|---|
| amino acids of SEQ ID NO: 217 | length (aa) | SEQ ID NO | amino acids of SEQ ID NO: 217 | length (aa) | SEQ ID NO |
| 1-509* | 509 | 217 | 36-509** | 474 | 122 |
| 1-500 | 500 | 216 | 36-500 | 465 | 152 |
| 1-499 | 499 | 215 | 36-499 | 464 | 131 |
| 1-498 | 498 | 214 | 36-498 | 463 | 153 |
| 1-497 | 497 | 213 | 36-497 | 462 | 132 |
| 1-496 | 496 | 212 | 36-496 | 461 | 154 |
| 1-495 | 495 | 211 | 36-495 | 460 | 133 |
| 1-494 | 494 | 210 | 36-494 | 459 | 155 |
| 1-493 | 493 | 209 | 36-493 | 458 | 134 |
| 1-492 | 492 | 208 | 36-492 | 457 | 156 |
| 1-491 | 491 | 207 | 36-491 | 456 | 135 |
| 1-490 | 490 | 281 | 36-490 | 455 | 137 |
| 1-489 | 489 | 280 | 36-489 | 454 | 136 |
| 1-488 | 488 | 279 | 36-488 | 453 | 157 |
| 1-487 | 487 | 278 | 36-487 | 452 | 138 |
| 1-486 | 486 | 277 | 36-486 | 451 | 158 |
| 1-485 | 485 | 276 | 36-485 | 450 | 139 |
| 1-484 | 484 | 275 | 36-484 | 449 | 140 |
| 1-483 | 483 | 274 | 36-483 | 448 | 130 |
| 1-482 | 482 | 273 | 36-482 | 447 | 123 |
| 1-481 | 481 | 272 | 36-481 | 446 | 124 |
| 1-480 | 480 | 271 | 36-480 | 445 | 125 |
| 1-479 | 479 | 270 | 36-479 | 444 | 126 |
| 1-478 | 478 | 269 | 36-478 | 443 | 127 |
| 1-477 | 477 | 268 | 36-477 | 442 | 128 |
| 1-476 | 476 | 267 | 36-476 | 441 | 141 |
| 1-475 | 475 | 266 | 36-475 | 440 | 142 |
| 1-474 | 474 | 265 | 36-474 | 439 | 143 |
| 1-473 | 473 | 264 | 36-473 | 438 | 144 |
| 1-472 | 472 | 263 | 36-472 | 437 | 145 |
| 1-471 | 471 | 262 | 36-471 | 436 | 146 |
| 1-470 | 470 | 261 | 36-470 | 435 | 147 |
| 1-469 | 469 | 260 | 36-469 | 434 | 148 |
| 1-468 | 468 | 259 | 36-468 | 433 | 149 |
| 1-467 | 467 | 258 | 36-467 | 432 | 129 |
| 1-466 | 466 | 257 | 36-466 | 431 | 150 |
| 1-465 | 465 | 256 | 36-465 | 430 | 151 |

*Wild-type precursor PH20
**Wild-type mature PH20

For example, soluble forms of PH20 include, for example, polypeptides that have the sequence of amino acids set forth in any of SEQ ID NOS: 123-158, or a sequence of amino acids that exhibits at least 85%, 86%, 87%, 88%, 89%, 90%, 91%, 92%, 93%, 94%, 95%, 96%, 97%, 98% or 99% sequence identity to a sequence of amino acids set forth in any of SEQ ID NOS: 123-158 and are soluble and retains hyaluronidase activity.

Variants of PH20, such as a human PH20 (e.g., a soluble human PH20) are known and are described in U.S. published appl. No. US2013/0302275. Any PH20 variant described in U.S. published appl. No. US2013/0302275 can be incorporated into a soluble PH20 polypeptide for use in the combination therapy provided herein. Such variants include those that exhibit increased resistance to a denaturation condition (e.g., a phenolic preservative) or increased activity. An example of such a polypeptide is a soluble human PH20 containing the amino acid replacement F204P, V58K or V58R with reference to the sequence of amino acids set forth in full length human PH20 set forth in SEQ ID NO: 122 or in a soluble human PH20 set forth in any of SEQ ID NOS: 123-158.

Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g., DG44 CHO cells).

ii. rHuPH20

Recombinant soluble forms of human PH20 have been generated and can be used in the compositions, combinations and methods provided herein. The generation of such soluble forms of recombinant human PH20 are described, for example, in U.S. Published Patent Application Nos. US20040268425; US 20050260186; US20060104968; 0520100143457; and International PCT Appl. No. WO2009111066. Examples of such polypeptides are those generated by expression of a nucleic acid molecule encoding amino acids 1-482 (set forth in SEQ ID NO: 273). Such an exemplary nucleic acid molecule is set forth in SEQ ID NO: 5. Post translational processing removes the 35 amino acid signal sequence, leaving a 447 amino acid soluble recombinant human PH20 (SEQ ID NO: 123). As produced in the culture medium there is heterogeneity at the C-terminus such that the product, designated rHuPH20, includes a mixture of species that can include any one or more of SEQ ID NOS. 123-128 in various abundance. Typically, rHuPH20 is produced in cells that facilitate correct N-glycosylation to retain activity, such as CHO cells (e.g., DG44 CHO cells).

d. Glycosylation of Hyaluronan-Degrading Enzymes

Glycosylation, including N- and O-linked glycosylation, of some hyaluronan-degrading enzymes, including hyaluronidases, can be important for their catalytic activity and stability. While altering the type of glycan modifying a glycoprotein can have dramatic affects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man) 3-GlcNAc-GlcNAc- cores attached via the amide nitrogen of Asn residues that fall within -Asn-Xaa-Thr/Ser-sequences (where Xaa is not Pro). Glycosylation at an -Asn-Xaa-Cys-site has been reported for coagulation protein C. In some instances, a hyaluronan-degrading enzyme, such as a hyaluronidase, can contain both N-glycosidic and O-glycosidic linkages. For example, PH20 has O-linked oligosaccharides as well as N-linked oligosaccharides. There are six potential N-linked glycosylation sites at N82, N166, N235, N254, N368, N393 of human PH20 exemplified in SEQ ID NO: 217. Amino acid residues N82, N166 and N254 are occupied by complex type glycans whereas amino acid residues N368 and N393 are occupied by high mannose type glycans. Amino acid residue N235 is occupied by approximately 80% high mannose type glycans and 20% complex type glycans. As noted above, O-linked glycosylation at S490 is not required for hyaluronidase activity.

In some examples, the hyaluronan-degrading enzymes for use in the compositions, combinations and/or methods provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO: 217 are glycosylated. In other examples, 3, 4, 5, or 6 of the N-glycosylation sites corresponding to amino acids N82, N166, N235, N254, N368, and N393 of SEQ ID NO: 217 are glycosylated. Typically, at least residues 235, 368 and 393 are glycosylated. Glycosylated amino acid residues minimally contain an N-acetylglucosamine moiety.

In some examples the hyaluronan-degrading enzymes are glycosylated at one or more native glycosylation sites. In other examples, the hyaluronan-degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

e. Sustained or Controlled Release Formulations and Vectors Encoding Soluble Hyaluronidases Various strategies are known to those of skill in the art for increasing serum half-life of hyaluronan-degrading enzymes, such as hyaluronidases, which is advantageous for systemic administration of hyaluronidases. Generally the hyaluronan-degrading enzyme is modified, such as by Pegylation or sialation. Other strategies also can be employed. These include formulating hyaluronan-degrading enzymes for sustained release, such as in vesicles, including liposomes, which can provide for time release or delayed release of the hyaluronan-degrading enzyme, and/or can be targeted to the tumor for release in the tumor. Exemplary of such formulations of hyaluronan-degrading enzymes, such as soluble hyaluronidases, are those described in US Publication US-2013-0251786-A1 and International PCT application Publication No. WO 2012/109387. Hyaluronan-degrading enzymes also can be encoded in expression vectors for in vivo expression, particularly tumor targeted or oncolytic vectors for expression in tumor cells (see, e.g., U.S. Pat. No. 8,450,470, and Publication No. US-2011-0152359-A1; see, also U.S. Publication No. US-2012-0148535). The methods and uses herein can be practiced with the vesicular formulations and/or expression vectors encoding a soluble hyaluronidases, which can be administered to a subject for combination therapy with a checkpoint inhibitor. The sustained release formulations also can be formulated to contain the checkpoint inhibitor, including any described herein, particularly the checkpoint inhibitor antibodies, such as anti-PD-L1 and anti-CTLA4.

i. Modified (Polymer-Conjugated) Hyaluronan-Degrading Enzymes

Covalent or other stable attachment (conjugation) of polymeric molecules, such as polyethylene glycol (PEGylation moiety (PEG)), to the hyaluronan-degrading enzymes, such as hyaluronidases, impart beneficial properties to the resulting hyaluronan-degrading enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Exemplary polymers that can be conjugated to the hyaluronan-degrading enzyme, such as the hyaluronidase, include natural and synthetic homopolymers, such as polyols (i.e., poly-OH), polyamines (i.e., poly-NH$_2$) and polycarboxyl acids (i.e., poly-COOH), and further heteropolymers i.e., polymers comprising one or more different coupling groups e.g., a hydroxyl group and amine groups. Examples of suitable polymeric molecules include polymeric molecules selected from among polyalkylene oxides (PAO), such as polyalkylene glycols (PAG), including polyethylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), poly(ethyleneimine) (PEI), linear polyamidoamines, polyacrylamide (PAAm), polydimethylacrylamide (PDAAm), polyvinyl alcohol (PVA), polycarboxylates, polyvinylpyrrolidone (PVP), poly-D,L-amino acids, polyethylene-co-maleic acid anhydride, polystyrene-co-maleic acid anhydride, dextrans including carboxymethyl-chitosan, dextrin, dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG; typically mPEG, which, in comparison to polysaccharides such as dextran and pullulan, have few reactive groups capable of cross-linking. Typically, the polymers are non-toxic polymeric molecules such as (m)polyethylene glycol (mPEG) which can be covalently conjugated to the hyaluronan-degrading enzyme, such as the hyaluronidase (e.g., to attachment groups on the protein's surface) using a relatively simple chemistry.

PEGylation of therapeutics has been reported to increase resistance to proteolysis, increase plasma half-life, and decrease antigenicity and immunogenicity. Examples of PEGylation methodologies are known in the art (see for example, Lu and Felix, *Int. J. Peptide Protein Res.*, 43:127-138, 1994; Lu and Felix, *Peptide Res.*, 6:140-6, 1993; Felix et al., *Int. J. Peptide Res.*, 46:253-64, 1995; Benhar et al., *J. Biol. Chem.*, 269: 13398-404, 1994; Brumeanu et al., *J Immunol.*, 154:3088-95, 1995; see also, Caliceti et al. (2003) *Adv. Drug Deliv. Rev.* 55(10):1261-77 and Molineux (2003) *Pharmacotherapy* 23 (8 Pt 2):3S-8S). PEGylation also can be used in the delivery of nucleic acid molecules in vivo. For example, PEGylation of adenovirus can increase stability and gene transfer (see, e.g., Cheng et al. (2003) *Pharm. Res.* 20(9):1444-51).

Suitable polymeric molecules for attachment to the hyaluronan-degrading enzymes, including hyaluronidases, include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g., Roberts et al., *Advanced Drug Delivery Review* (2002) 54: 459-476; Harris and Zalipsky, S (eds.) "Poly(ethylene glycol), Chemistry and Biological Applications" ACS Symposium Series 680, 1997; Mehvar et al., *J. Pharm. Pharmaceut. Sci.*, 3(1):125-136, 2000; Harris, (2003) *Nature Reviews Drug Discovery* 2:214-221; and Tsubery, (2004) *J Biol. Chem* 279(37):38118-24). The polymeric molecule can be of a molecular weight typically ranging from about 3 kDa to about 60 kDa. In some embodiments the polymeric molecule that is conjugated to a protein, such as a hyaluronidase, for example a PH20, has a molecular weight of between or about between 5 to 60 kDa, such as at least or about at least or 5, 10, 15, 20, 25, 30, 35, 40, 45, 50, 55, 60 or more than 60 kDa.

PEGylated Soluble Hyaluronan-Degrading Enzymes

The hyaluronan-degrading enzyme used in the combinations and methods herein can be a PEGylated hyaluronan-degrading enzyme, such as a PEGylated soluble hyaluronan-degrading enzyme. In one example, it is a PEGylated soluble hyaluronidase, e.g., PEGylated PH20. Various methods of modifying polypeptides by covalently attaching (conjugating) a PEG or PEG derivative (i.e., "PEGylation") are known in the art (see e.g., U.S. 2006/0104968; U.S. Pat. Nos. 5,672,662; 6,737,505; and U.S. 2004/0235734). Techniques for PEGylation include, but are not limited to, specialized linkers and coupling chemistries (see e.g., Roberts et al., Adv. Drug Deliv. Rev. 54:459-476, 2002), attachment of multiple PEG moieties to a single conjugation site (such as via use of branched PEGs; see e.g., Guiotto et al., Bioorg. Med. Chem. Lett. 12:177-180, 2002), site-specific PEGylation and/or mono-PEGylation (see e.g., Chapman et al., Nature Biotech. 17:780-783, 1999), and site-directed enzymatic PEGylation (see e.g., Sato, Adv. Drug Deliv. Rev., 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Numerous reagents for PEGylation have been described in the art. Such reagents include, but are not limited to, N-hydroxysuccinimidyl (NHS) activated PEG; succinimidyl mPEG mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG; mPEG-benzotriazole carbonate, propionaldehyde PEG; mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., Bioconjugate Chem. 6:62-69, 1995; Veronese et al., J. Bioactive Compatible Polymers 12:197-207, 1997; U.S. Pat. Nos. 5,672,662; 5,932,462; 6,495,659; 6,737,505; 4,002,531; 4,179,337; 5,122,614; 5,324,844; 5,446,090; 5,612,460; 5,643,575; 5,766,581; 5,795,569; 5,808,096; U.S. 5,900,461; U.S. Pat. Nos. 5,919,455; 5,985,263; 5,990,237; 6,113,906; 6,214,966; 6,258,351; 6,340,742; 6,413,507; 6,420,339; 6,437,025; 6,448,369; 6,461,802; 6,828,401; 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; U.S. 2004/0235734; WO0500360; U.S. 2005/0114037; U.S. 2005/0171328; U.S. 2005/0209416; EP 1064951; EP 0822199; WO 01076640; WO 0002017; WO 0249673; WO 9428024; and WO 0187925).

ii. Sustained or Controlled Release Formulations and Vectors Encoding Soluble Hyaluronidases The hyaluronan-degrading enzyme compositions can be provided in sustained or controlled release formulations. They can be co-formulated with the checkpoint inhibitor and/or other anti-tumor agent. In some examples, the sustained or controlled release formulations also contain another therapeutic agent(s), for example, the checkpoint inhibitor and/or an additional anti-tumor agent. The hyaluronan-degrading enzyme, such as the soluble hyaluronidases, can be provided in vectors for administration. Vectors include oncolytic viral vectors, such adenovirus oncolytic vectors and vaccinia viruses that encode and express the hyaluronan-degrading enzyme. They also can encode other anti-cancer protein therapeutics, such as the checkpoint inhibitor, including any described herein.

The formulations can be formulated for local or systemic injection Exemplary sustained release formulations include, but are not limited to, lipid vesicles including unilamellar vesicles (LUV) and multilamellar vesicles (MVL), drug-resin complexes (resinates), and depot formulations. Such sustained or controlled release formulations are known to one of skill in the art. For example, a hyaluronan-degrading enzyme can be encapsulated in a colloidal dispersion system or in polymer stabilized crystals. Colloidal dispersion systems include nanocapsules, microspheres, beads, and lipid based systems, including oil-in-water emulsions, micelles, mixed micelles, and liposomes (see, e.g., U.S. Pat. No. 5,631,018) Examples of processes to make multilamellar and unilamellar liposomes are known in the art (see e.g. U.S. Pat. Nos. 4,522,803, 4,310,506, 4,235,871, 4,224,179, 4,078,052, 4,394,372, 4,308,166, 4,485,054 and 4,508,703). Other examples of slow release delivery vehicles are biodegradable hydrogel matrices (U.S. Pat. No. 5,041,292), dendritic polymer conjugates (U.S. Pat. No. 5,714,166), and multivesicular liposomes (DepoFoam®, DepoTech, San Diego, Calif.) (U.S. Pat. Nos. 5,723,147 and 5,766,627). One type of microspheres suitable for encapsulating the compositions for local injection, is poly(D,L-lactide) microspheres, as described in Fletcher, D. Anesth. Analg. 84:90-94 (1997).

In particular, the sustained release formulations provided can be designed such that the enzyme (or other agent(s)) is released at a predetermined rate or such that a constant level of drug is maintained for a specific period of time. In particular, the formulations permit a controlled release of the hyaluronan-degrading enzyme (or other agent(s)) to the local tissue, such as tumor tissue. The rate of release is sufficiently slow such that the resulting effect of the enzyme on HA degradation in the tissue (e.g. stroma) is extended over many hours, days, weeks or months. The optimum release rate and duration for the sustained release formulations of a hyaluronan-degrading enzyme can be determined by those of skill in the art based on the pharmacological properties of the specific agents.

If needed, the activity of hyaluronan-degrading enzyme released into the blood or serum can be measured. Any assay known to one of skill in the art to measure the hyaluronidase in the plasma can be performed. For example, a microturbidity assay or enzymatic assay can be performed on protein in plasma. It is understood that plasma normally contains hyaluronidase enzymes. Such plasma hyaluronidase enzymes typically have activity at an acidic pH (U.S. Pat. No. 7,105,330). Hence, before treatment with a sustained release formulation as described herein, the plasma levels of hyaluronidase should be determined and used as a baseline. Subsequent measurements of plasma hyaluronidase levels after treatment can be compared to the levels before treatments. Alternatively, the assay can be performed under pH conditions that suppress endogenous lysosomal hyaluronidase activity in plasma, which normally exhibits activity at acidic pH. Thus, where the hyaluronan-degrading enzyme is active at neutral pH (e.g. human PH20), only the level of the neutral-active enzyme is measured.

Further, the sustained release formulations provided herein can be designed such that the hyaluronan-degrading enzyme is relatively stable and active. For example, the sustained release formulations are provided such that the total hyaluronan-degrading enzyme activity of the formulation is at or between 25,000 U/mg to 200,000 U/mg, for example 40,000 U/mg to 150,000 U/mg such as 75,000 U/mg to 120,000 U/mg and in particular at least or 40,000 U/mg, 50,000 U/mg, 60,000 U/mg, 70,000 U/mg, 80,000 U/mg, 90,000 U/mg, 100,000 U/mg, 110,000 U/mg, 120,000 U/mg, 130,000 U/mg, 140,000 U/mg, 150,000 U/mg or more.

Non-limiting examples of sustained release formulations and exemplary formulations are provided in the examples below. See, also published PCT application WO 2012/109387.

a) Multivesicular Liposomes (MVL)

Provided herein are synthetic membrane vesicles, such as multivesicular liposomes (MVL) formulations, that include the hyaluronan-degrading enzyme, and in particular a hyaluronidase such as PH20 or soluble or recombinant PH20. In some examples, MVL-co-formulations are provided that additionally contain another therapeutic drug, such as the checkpoint inhibitor and/or other anti-tumor or anti-cancer agent. Multivesicular liposome formulations contain microscopic, spherical particles composed of numerous non-concentric aqueous chambers encapsulating a drug or agent to be delivered. The individual chambers are separated by lipid bilayer membranes composed of synthetic duplicates or naturally occurring lipids, resulting in a delivery vehicle that is both biocompatible and biodegradable. In examples herein, hyaluronan-degrading enzymes or other therapeutic agents that are hydrophilic can be encapsulated in the aqueous phase. In other examples herein, an MVL co-formulation is provided by co-encapsulation of a hydrophilic drug and a hydrophobic drug in the same formulation. For example, in such MVL co-formulations, the hyaluronan-degrading enzyme is encapsulated in the aqueous phase and a hydrophobic drug, for example finasteride or dutasteride, are intercalated into the lipid phase.

The membrane vesicles can be used in methods for delivering a hyaluronan-degrading enzyme, and if desired also another agent, to a subject to be used as an adjuvant, spreading agent or therapeutic. In particular, the membrane vesicles are provided in pharmaceutical compositions for use as a therapeutic agent.

Multivesicular liposomes (MVL) are made based on processes known to one of skill in the art (see e.g. U.S. Pat. Nos. 5,723,147; 5,766,627; 6,106,858; 6,306,432; 5,962,016; 6,241,999; published U.S. Patent Appl. No. US2007/0235889 and US2010/030550; and published International Appl. No. WO02/096368). In generating such liposomes, any of the hyaluronan-degrading enzyme compositions described herein, or known to one of skill in the art, can be prepared as part of multivesicular liposomes. Briefly, a "water-in-oil" emulsion containing a hyaluronan-degrading enzyme first is made by dissolving amphipathic lipids and neutral lipids in a volatile organic solvent for the lipid component, adding to the lipid component an immiscible first aqueous component containing the enzyme and/or other agent to be included, and one or more helper molecules, i.e. osmotic excipients, that provide useful and beneficial properties to the MVLs. The mixture is emulsified by mixture, for example, mechanically as by mixing, shaking, sonication, by ultrasonic energy, nozzle atomization, or combinations thereof. The hyaluronan-degrading enzyme can be contained in the first aqueous component or the lipid component or both. The whole water-in-oil emulsion is then mixed with the second aqueous component and then agitated mechanically, as above, to form solvent spherules suspended in the second aqueous component. The solvent spherules contain multiple aqueous droplets with the substance to be encapsulated dissolved therein. The volatile organic solvent is removed, for instance by evaporation, from the spherules. When the solvent is completely evaporated, multivesicular liposomes are formed. The MVLs are resuspended, washed and stored in a third aqueous solution such as saline or suitable buffer that allows particle stability at storage temperatures. Representative gases satisfactory for use in evaporating the solvent include nitrogen, helium, argon, oxygen, hydrogen and carbon dioxide. Alternatively, the organic solvent can be removed by sparging, rotary evaporation or solvent selective membranes.

As described in the published PCT application WO 2012/109387, hydrophobic molecules can be incorporated into the lipid bilayer by dissolving the lipids and the hydrophobic drug into an organic solvent prior to mixing with a first aqueous component containing the hydrophilic drug (e.g. a hyaluronan-degrading enzyme). Hence, the methods can be used to also generate MVL co-formulations of a hydrophobic and hydrophilic drug.

Many different types of volatile hydrophobic solvents, such as ethers, halogenated ethers, hydrocarbons, esters, halogenated hydrocarbons, or Freons can be used as the lipid-phase solvent. For example, diethyl ether, isopropyl and other ethers, chloroform, methylene chloride, tetrahydrofuran, ethyl acetate, Forane and combinations thereof can be used in making multivesicular liposomes.

Various types of lipids can be used to make multivesicular liposomes, so long as the lipid component contains one neutral lipid and one amphipathic lipid. Examples of neutral lipids include diglycerides, such as diolefin, dipalmitolein; propylene glycol esters such as mixed diesters of caprylic/capric acids on propylene glycol; triglycerides such as triolein, tripalmitolein, trilinolein, tricaprylin and trilaurin; vegetable oils, such as soybean oil; lard or beef fat; squalene; tocopherol; and combinations thereof. In particular examples, slow release neutral lipids include, for example, triolein, tripalmitolein, trimyristolein, trilaurin, and tricaprin. Fast release neutral lipids include, for example, tricaprylin and tricaproin and mixtures thereof. Examples of amphipathic lipids include those with net negative charge, zero net charge, and net positive charge at pH 7.4. These include zwitterionic, acidic or cationic lipids. Such exemplary amphipathic lipids include, but are not limited to, phosphatidylglycerol (PG), cardiolipin (CL), phosphatidylserine (PS), phosphatidic acid (PA), phosphatidylinositol, phosphatidylcholine (PC), phosphatidylethanolamine (PE), sphingomyelin, diacyl trimethylammonium propane (DITAP) and combinations thereof. Additionally, cholesterol or plant sterols can be used to make multivesicular liposomes. The lipid component chosen also can be one that has a melting point below the temperature at which the MVL is to be stored and/or used (see e.g. U.S. Pat. No. 5,962,016).

In examples of the synthetic membrane vesicles, the hyaluronan-degrading enzyme, and in particular a hyaluronidase such as PH20 or recombinant PH20, can be prepared in the presence of one or more excipients that preserve or enhance the stability of the enzyme and/or increase the rate of formation of the vesicles. In particular examples, the excipient is hyaluronic acid (also called hyaluronan; HA).

The particle size of the resulting MVL can vary. It is within the level of one of skill in the art to determine the size of a membrane vesicle and to select a vesicle based on a desired application. For example, particle size analysis can be performed, for example using a laser diffraction particle size analyzer. In some examples, membrane vesicles provided herein have an average diameter that is from about or between 0.5 µm to 100 µm, for example at least or about or 0.5 µm, 1 µm, 5 µm, 10 µm, 15 µm, 20 µM, 50 µm or 100 µm.

The resulting MVL formulations or co-formulations can be further diluted or suspended by addition of suspending medium or other biologically acceptable carrier to obtain injectable or implantable slow release depot formulations. Common suitable carriers include aqueous or non-aqueous solutions, suspensions and emulsions. Examples of non-aqueous solutions are propylene glycol, polyethylene glycol, vegetable oils, such as olive oil, and injectable organic esters such as ethyl oleate. Aqueous carriers include water, alcoholic aqueous solutions, emulsions or suspensions, including saline and buffered media. Parenteral vehicles include sodium chloride solutions, Ringer's dextrose, dextrose, and lactated Ringer's solution. Intravenous vehicles include fluid and nutrient replenishers, electrolyte replenishers (such as those based on Ringer's dextrose). Preservatives and other additives can also be present, such as antimicrobials, antioxidants, chelating agents, and inert gases (see, Remingtons Pharmaceutical Sciences, 16$^{th}$ Ed., A. Oslo, ed., Mack, Easton, Pa. 1980). Further details for preparation of the vesicles are described, for example, in published PCT application WO 2012/109387, and, thus are known to those of skill in the art.

b) MVL Co-Formulations

Provided herein are vesicles that contain another therapeutic agent or agent with the hyaluronan-degrading enzyme. The other therapeutic agent can be any drug or agent known to one of skill in the art, and particularly include a checkpoint inhibitor and/or other anti-cancer agent. The other agent can be hydrophilic or hydrophobic. In some examples, the MVL co-formulations are prepared by mixing of a first aqueous component containing the hyaluronan-degrading enzyme and other agent with the lipid component in organic solvent. In other examples, the other agent is a hydrophobic drug and the MVL co-formulations are prepared by mixing of a first aqueous component containing the hyaluronan-degrading enzyme and with the lipid component in organic solvent that also contains the hydrophobic drug. It is found herein that inclusion of the hydrophobic drug with the lipid component in organic solvent results in encapsulation or intercalation of the hydrophobic drug into the lipid phase of the MVL. Hence, when generated in combination with a hyaluronan-degrading enzyme, the MVL formulations contain a hydrophilic and hydrophobic drug co-encapsulated in the same formulation, whereby the hyaluronan-degrading enzyme is in the aqueous phase and the hydrophobic drug is in the lipid phase. Exemplary hydrophobic drugs include, but are not limited to, docetaxel, gemcitabine, glucocorticoids. With respect to generation of MVL co-formulations containing a hydrophobic drug, it is found herein that the morphology of the lipid co-formulation particles can be affected by the drug concentration and lipid concentration. It is within the level of one of skill in the art to determine the optimal concentrations of drug and lipids in order to obtain a particle of sufficient morphology for therapeutic applications while retaining activity of the active encapsulated drugs. The Examples exemplify procedures to assess and monitor morphology and activities D. Methods of Producing Nucleic Acids and Encoded Polypeptides of Hyaluronan-degrading enzymes and Immune Checkpoint Inhibitors (e.g., Antibodies)

Polypeptides for use in the methods and compositions provided herein, including polypeptides of a hyaluronan-degrading enzyme (e.g., soluble hyaluronidase, such as a PH20) or an immune checkpoint inhibitor (e.g., antibody), can be obtained by methods well-known in the art for protein purification and recombinant protein expression. Recombinant DNA methods are within the purview of those skilled in the art. DNA encoding a polypeptide of interest, such as any described herein, can be synthetically produced or can be readily isolated and sequenced using conventional procedures (e.g., by using oligonucleotide probes that are capable of binding specifically to genes). For example, any cell or tissue source known to produce or express a polypeptide of interest can serve as a source of such DNA. Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening. In another example, if the sequence of the DNA is known or determined, nucleic acid sequences can be constructed using gene synthesis techniques.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g., blood, serum, saliva) or other samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Further, mutagenesis techniques also can be employed to generate modified forms of a protein of interest. The DNA also can be modified. For example, gene synthesis or routine molecular biology techniques can be used to effect insertion, deletion, addition or replacement of nucleotides, for example, to alter the properties of the protein, such as the binding properties or stability of the antibody or the enzymatic activity of the hyaluronan-degrading enzyme.

Additional nucleotide sequences can be joined to a polypeptide-encoding nucleic acid molecule. In one example linker sequences can be added, such as sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues, such as sequences of bases specifying protein binding regions, also can be linked to polypeptide-encoding nucleic acid molecules. Such regions include, but are not limited to, sequences of residues that facilitate or encode proteins that facilitate uptake of the polypeptide into specific target cells, or otherwise alter pharmacokinetics of the product of the synthetic gene.

In addition, tags or other moieties can be added, for example, to aid in detection or affinity purification of the polypeptide. For example, additional nucleotide residue sequences such as sequences of bases specifying an epitope tag or other detectable marker also can be linked to enzyme-encoding nucleic acid molecules. Examples of such sequences include nucleic acid sequences encoding a His tag (e.g., 6×His, SIH; SEQ ID NO: 31) or Flag Tag (DYKDDDDK; SEQ ID NO: 20).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Choice of vector can depend on the desired application. The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing.

After insertion of the nucleic acid, the vectors typically are introduced into host cells, for example, to amplify the protein genes for replication and/or expression thereof. Recombinant molecules can be introduced into host cells via, for example, transformation, transfection, infection, electroporation and sonoporation, so that many copies of the gene sequence are generated. In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA. In such examples, a vector suitable for high level expression is used. Exemplary vectors are described below. The polypeptides can be expressed using standard cell culture and other expression systems known in the art. The proteins can be purified.

1. Isolation or Preparation of Nucleic Acid Encoding Polypeptides a. Hyaluronan-Degrading Enzyme Provided herein are nucleic acid molecules encoding any of the hyaluronan-degrading enzymes described herein, such as any described in Section C above. For example, provided herein are nucleic acids encoding any of the soluble PH20 polypeptides that has the sequence of amino acids set forth in any of SEQ ID NOS: 123-158, or a sequence of amino acids that exhibits at least 85%, 86%, 87%, 88%, 89%, 90%, 91%, 92%, 93%, 94%, 95%, 96%, 97%, 98% or 99% sequence identity to a sequence of amino acids set forth in any of SEQ ID NOS: 123-158. As described above, the DNA encoding a hyaluronan-degrading enzyme can be synthetically produced or can be readily isolated using conventional procedures. Any method available in the art can be used to obtain a full length cDNA (i.e., encompassing the entire coding region), or genomic DNA clone, encoding a hyaluronidase, such as from a cell or tissue source. Modified, such as truncated or variant soluble, hyaluronidases can be engineered from a wildtype polypeptide using recombinant DNA techniques, including site-directed mutagenesis.

The nucleic acid molecule can be inserted into a vector for expression. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. Other exemplary vectors are described below.

b. Immune Checkpoint Inhibitors (e.g., Antibodies)

Provided herein are nucleic acid molecules encoding any of the immune checkpoint inhibitors described herein, such as any described in Section C above. For example, provided herein are nucleic acid molecules encoding an anti-immune checkpoint protein antibody, such as an anti-CTLA4 or anti-PD-1 antibody, such as any described in Section C above. As described above, nucleic acid molecules and proteins provided herein can be made by any method known to one of skill in the art. Such procedures are routine and are well-known to the skill artisan. They include routine molecular biology techniques including gene synthesis, PCR, ligation, cloning, transfection and purification techniques.

Anti-immune checkpoint protein antibodies, such as anti-CTLA4 or anti-PD-1 antibodies, can be generated or expressed as full-length antibodies or as antibodies that are less than full-length, including, but not limited to antigen-binding fragments thereof, such as, for example, Fab, Fab', Fab hinge, F(ab')$_2$, single-chain Fv (scFv), scFv tandem, Fv, dsFv, scFv hinge, scFv hinge (ΔE) diabody, Fd and Fd' fragments. Generally, an antibody fragment contains a variable heavy chain and a variable light chain of an antibody, such as any described herein.

Various techniques have been developed for the production of antibodies and antibody fragments (see, for example, Harlow & Lane, 1988, "Antibodies: A Laboratory Manual", Cold Spring Harbor Laboratory, New York). For example, antibody fragments can be prepared by proteolytic hydrolysis of intact antibodies (see e.g., Morimoto et al. (1992) *Journal of Biochemical and Biophysical Methods*, 24:107-117; Brennan et al. (1985) *Science*, 229:81). For example, fragments of antibody molecules can be generated by enzymatic cleavage, such as by pepsin or papain cleavage using conventional methods. For example, upon protease cleavage by papain, a dimer of the heavy chain constant regions, the Fc domain, is cleaved from the two Fab regions (i.e., the portions containing the variable regions).

Fragments also can be produced directly by recombinant host cells. For example, Fab, Fv and scFv antibody fragments can all be expressed in and secreted from host cells, such as *E. coli*, thereby facilitating production of large amounts of these fragments. Also, Fab'-SH fragments can be chemically coupled to form F(ab')$_2$ fragments (Carter et al. (1992) *Bio/Technology*, 10:163-167). According to another approach, F(ab')$_2$ fragments can be isolated directly from recombinant host cell culture. In some examples, the antibody is a single chain Fv fragment (scFv) (see, e.g., International Patent Pub. No. WO93/16185; and U.S. Pat. Nos. 5,571,894 and 5,587,458). Fv and scFv are the only species with intact combining sites that are devoid of constant regions; thus, they are suitable for reduced nonspecific binding during in vivo use. scFv fusion proteins can be constructed to yield fusion of an effector protein at either the amino or the carboxy terminus of an scFv. The antibody fragment can also be a linear antibody (see, e.g., U.S. Pat. No. 5,641,870). Such linear antibody fragments can be monospecific or bispecific. Other techniques for the production of antibody fragments are known to one of skill in the art.

In some examples, the antibody in the provided combinations, methods and uses, is a single chain antibody. A single chain antibody can be generated from the antigen-binding domain of an antibody. Methods for generating single chain antibodies using recombinant techniques are known in the art, such as those described in, for example, Marasco et al. (1993) *Proc. Natl. Acad. Sci. USA* 90:7889-7893; Whitlow and Filpula (1991) *Methods*, 2: 97-105; Bird et al. (1988) *Science* 242:423-426; Pack et al. (1993) *Bio/Technology* 11:1271-77; and U.S. Pat. Nos. 4,946,778, 5,840,300, 5,667,988, and 5,658,727.

Single chain antibodies can be recombinantly engineered by joining a heavy chain variable region ($V_H$) and light chain variable region ($V_L$) of a specific antibody. The particular nucleic acid sequences for the variable regions can be cloned by standard molecular biology methods, such as, for example, by polymerase chain reaction (PCR) and other recombination nucleic acid technologies. Methods for producing scFvs are described, for example, by Whitlow and Filpula (1991) *Methods;* 2: 97-105; Bird et al. (1988) *Science* 242:423-426; Pack et al. (1993) Bio/Technology 11:1271-77; and U.S. Pat. Nos. 4,946,778, 5,840,300, 5,667, 988, 5,658,727, and 5,258,498.

The antibodies included in the combinations, methods and uses herein can be humanized. Humanized forms of non-human (e.g., murine) antibodies are genetically engineered chimeric antibodies or antibody fragments having minimal-portions derived from non-human antibodies. Humanized antibodies include antibodies in which complementary determining regions of a human antibody (recipient antibody) are replaced by residues from a complementary determining region of a non-human species (donor antibody) such as mouse, rat or rabbit having the desired functionality. In some instances, Fv framework residues of the human antibody are replaced by corresponding non-human residues. Humanized antibodies can also contain residues which are found neither in the recipient antibody nor in the imported complementarity determining region or framework sequences. In general, the humanized antibody contains substantially all of at least one, and typically two, variable domains, in which all, or substantially all, of the complementarity determining regions correspond to those of a non-human antibody and all, or substantially all, of the framework regions correspond to those of a relevant human consensus sequence. Humanized antibodies also can include at least a portion of an antibody constant region, such as an Fc region, typically derived from a human antibody (see, for example, Jones et al., 1986. *Nature* 321:522-525; Riechmann et al., 1988, *Nature* 332:323-329; Presta, 1992, *Curr. Op. Struct. Biol.* 2:593-596).

Methods for humanizing non-human antibodies are well-known in the art. Generally, the humanized antibody has one or more amino acid residues introduced into it from a source which is non-human. These non-human amino acid residues, often referred to as imported residues, are typically taken from an imported variable domain. Humanization can be performed by substituting human complementarity determining regions with, for example, corresponding rodent complementarity determining regions (see, for example, Jones et al., 1986, *Nature* 321:522-525; Reichmann et al., 1988. *Nature* 332:323-327; Verhoeyen et al., 1988, *Science* 239:1534-15361; U.S. Pat. No. 4,816,567). Accordingly, such humanized antibodies are chimeric antibodies, wherein substantially less than an intact human variable domain has been substituted by the corresponding sequence from a non-human species. In practice, humanized antibodies can be typically human antibodies in which some complementarity determining region residues and possibly some framework residues are substituted by residues from analogous sites in rodent antibodies.

Methods of identifying antibodies against a target, such as an immune checkpoint protein, also are known. For example, antibodies can be identified using various techniques known in the art, including phage display libraries (see, for example, Hoogenboom & Winter, 1991, *J. Mol. Biol.* 227:381; Marks et al., 1991, *J. Mol. Biol.* 222:581; Cole et al., 1985, In: Monoclonal antibodies and Cancer Therapy, Alan R. Liss, pp. 77; Boerner et al., 1991. *J. Immunol.* 147:86-95). Also, antibodies can be generated via any one of several methods which employ induction of in vivo production of antibody molecules, screening of immunoglobulin libraries (Orlandi. et al., 1989. *Proc. Natl. Acad. Sci. U.S.A.* 86:3833-3837; Winter et al., 1991, *Nature* 349: 293-299) or generation of monoclonal antibody molecules by cell lines in culture. These include, but are not limited to, the hybridoma technique, the human B-cell hybridoma technique, and the Epstein-Barr virus (EBV)-hybridoma technique (Kohler et al., 1975. Nature 256:4950497; Kozbor et al., 1985. J. Immunol. Methods 81:31-42; Cote et al., 1983. *Proc. Natl. Acad. Sci. USA* 80:2026-2030; Cole et al., 1984. *Mol. Cell. Biol.* 62:109-120).

Nucleic acid sequences of the variable heavy chain and variable light chain of an antibody or fragment thereof, such as any described herein, can be inserted into vectors for expression of whole antibodies and antibody fragments described herein. For example, nucleic acid encoding the variable heavy chain and variable light chain sequences of Ipilimumab (SEQ ID NOS: 22 and 24, respectively) or the variable heavy chain and variable light chain sequences of any antibody as described herein can be inserted into a suitable expression vector described herein or known to one of skill in the art. All or a portion of the constant region of the heavy chain or light chain also can be inserted or contained in the vector for expression of IgG antibodies or fragments thereof. In addition, $V_H$-$C_H$1 and $V_L$-$C_L$ sequences can be inserted into a suitable expression vector for expression of Fab molecules. Variable heavy chain and variable light chain domains of an antibody can be expressed in a suitable expression vector, such as a vector encoding a linker between the variable heavy chain and variable light chain to produce single chain antibodies. Exemplary linkers include the glycine rich flexible linkers (-$G_4S$-)$_n$, where n is a positive integer, such as 1 (SEQ ID NO: 37), 2 (SEQ ID NO: 38), 3 (SEQ ID NO: 39), 4 (SEQ ID NO: 40), 5 (SEQ ID NO: 41), or more.

2. Vectors

For recombinant expression of one or more of the desired proteins, such as any hyaluronan-degrading enzyme polypeptide or immune checkpoint inhibitor (e.g., anti-immune checkpoint protein antibody) described herein, the nucleic acid containing all or a portion of the nucleotide sequence encoding the protein can be inserted into an appropriate expression vector. The sequence of nucleotides that encodes the protein also is generally coupled to a native or heterologous signal sequence. The vectors can be selected for expression of the enzyme protein in the cell or such that the protein is expressed as a secreted protein.

Vector selection can depend on the desired application. Many expression vectors are available and known to those of skill in the art. The choice of an expression vector is influenced by the choice of host expression system. Such selection is well within the level of skill of the skilled artisan. The vector contains the necessary elements for the transcription and translation of the inserted protein coding sequence. In general, expression vectors can include transcriptional promoters and optionally enhancers, translational signals, and transcriptional and translational termination signals. The necessary transcriptional and translational signals also can be supplied by the native promoter for enzyme genes, and/or their flanking regions.

Expression vectors that are used for stable transformation typically have a selectable marker which allows for selection and maintenance of the transformed cells. In some cases, an origin of replication can be used to amplify the copy number of the vectors in the cells. Vectors also generally can contain additional nucleotide sequences operably linked to the ligated nucleic acid molecule (e.g., His tag, Flag tag). For applications with antibodies, vectors generally include sequences encoding the constant region. Thus, antibodies or portions thereof also can be expressed as protein fusions. A fusion protein can be generated to add additional functionality to a polypeptide. Examples of fusion proteins include, but are not limited to, fusions of a signal sequence, an epitope tag used for detection or visualization (e.g., a $His_6$ tag or a myc tag), or a tag for purification (e.g., a GST fusion), and a sequence for directing protein secretion and/or membrane association.

A variety of host-vector systems can be used to express the protein coding sequence. These include but are not limited to mammalian cell systems infected with virus (e.g., vaccinia virus, adenovirus and other viruses); insect cell systems infected with virus (e.g., baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s).

For example, expression of the proteins can be controlled by any promoter/enhancer known in the art. Suitable bacterial promoters are well-known in the art, and include promoters for mammalian cells, yeast cells and insect cells, such as promoters exemplified below. Selection of the promoter used to direct expression of a heterologous nucleic acid depends on the particular application. In a specific embodiment, the promoter is not native to the genes for a desired protein. Promoters which can be used include but are not limited to those for use in eukaryotic expression vectors, such as the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); in prokaryotic expression vectors, such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983); see also "Useful Proteins from Recombinant Bacteria": in Scientific American 242: 74-94 (1980); plant expression vectors, such as the nopaline synthetase promoter (Herrera-Estrella et al., *Nature* 303: 209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In addition to the promoter, the expression vector typically contains a transcription unit or expression cassette that contains all the additional elements required for the expression of the protein in host cells. A typical expression cassette contains a promoter operably linked to the nucleic acid sequence encoding the protein and signals required for efficient polyadenylation of the transcript, ribosome binding sites and translation termination. Additional elements of the cassette can include enhancers. In addition, the cassette typically contains a transcription termination region downstream of the structural gene to provide for efficient termination. The termination region can be obtained from the same gene as the promoter sequence or can be obtained from different genes.

Some expression systems have markers that provide gene amplification such as thymidine kinase and dihydrofolate reductase. Alternatively, high yield expression systems not involving gene amplification are also suitable, such as using a baculovirus vector in insect cells, with a nucleic acid sequence encoding a protein under the direction of the polyhedron promoter or other strong baculovirus promoter. In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene).

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Exemplary expression vectors include any mammalian expression vector such as, for example, pCMV. For bacterial expression, such vectors include pBR322, pUC, pSKF, pET23D, and fusion vectors such as MBP, GST and LacZ. Other eukaryotic vectors, for example any containing regulatory elements from eukaryotic viruses, can be used as eukaryotic expression vectors. These include, for example, SV40 vectors, papilloma virus vectors, and vectors derived from Epstein-Bar virus. Exemplary eukaryotic vectors include pMSG pAV009/A+, pMT010/A+, pMAMneo-5, baculovirus pDSCE, and any other vector allowing expression of proteins under the direction of the CMV promoter, SV40 early promoter, SV40 late promoter, metallothionein promoter, murine mammary tumor virus promoter, Rous sarcoma virus promoter, polyhedron promoter, or other promoters shown effective for expression in eukaryotes.

An exemplary vector for mammalian cell expression, such as for a hyaluronan-degrading enzyme, is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

Exemplary plasmid vectors for transformation of E. coli cells, include, for example, the pQE expression vectors (available from Qiagen, Valencia, Calif.; see also literature published by Qiagen describing the system). pQE vectors have a phage T5 promoter (recognized by E. coli RNA polymerase) and a double lac operator repression module to provide tightly regulated, high-level expression of recombinant proteins in E. coli, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of E. coli cells, include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible E. coli lac operator, and the lac repressor gene; pET 12a-c, which contains the T7 promoter, T7 terminator, and the E. coli ompT secretion signal; and pET 15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator.

Any methods known to those of skill in the art for the insertion of DNA fragments into a vector can be used to construct expression vectors containing a nucleic acid encoding a protein or an antibody chain. These methods can include in vitro recombinant DNA and synthetic techniques and in vivo recombinants (genetic recombination). The insertion into a cloning vector can, for example, be accomplished by ligating the DNA fragment into a cloning vector which has complementary cohesive termini. If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized nucleic acids encoding restriction endonuclease recognition sequences.

For expression of antibodies, generally, nucleic acid encoding the heavy chain of an antibody is cloned into a vector and the nucleic acid encoding the light chain of an antibody is cloned into a vector. The genes can be cloned into a single vector for dual expression thereof, or into separate vectors. In one example, nucleic acid encoding the heavy chain of an antibody, is ligated into a first expression vector and nucleic acid encoding the light chain of an antibody is ligated into a second expression vector. The expression vectors can be the same or different, although generally they are sufficiently compatible to allow comparable expression of proteins (heavy and light chain) therefrom. If desired, the vectors also can contain further sequences encoding additional constant region(s) or hinge regions to generate other antibody forms. Exemplary vectors include, but are not limited to, pγ1HC and pκLC (Tiller et al. (2008) *J Immunol. Methods*, 329:112-24). Other expression vectors include the light chain expression vector pAG4622 and the heavy chain expression vector pAH4604 (Coloma et al. (1992) *J Immunol. Methods*, 152:89-104). The pAG4622 vector contains the genomic sequence encoding the C-region domain of the human κ L chain and the gpt selectable marker. The pAH4604 vectors contains the hisD selectable marker and sequences encoding the human H chain γ1 C-region domain. In another example, the heavy and light chain can be cloned into a single vector that has expression cassettes for both the heavy and light chain.

3. Cells and Expression

Generally, any cell type that can be engineered to express heterologous DNA and has a secretory pathway is suitable for expression of proteins. Such methods are known to those of skill in the art, including in vivo and in vitro methods. Desired proteins can be expressed in any organism suitable to produce the required amounts and forms of the proteins, such as for example, the amounts and/or forms needed for administration and treatment.

Expression hosts include prokaryotic and eukaryotic organisms such as bacterial cells (e.g., E. coli), yeast, fungal cells, Archaea, plant cells, insect cells, mammalian cells, including human cell lines and transgenic animals. Expression hosts can differ in their protein production levels as well as the types of post-translational modifications that are present on the expressed proteins. Further, the choice of expression host is often related to the choice of vector and transcription and translation elements used. For example, the choice of expression host is often, but not always, dependent on the choice of precursor sequence utilized. For example, many heterologous signal sequences can only be expressed in a host cell of the same species (i.e., an insect cell signal sequence is optimally expressed in an insect cell). In contrast, other signal sequences can be used in heterologous hosts such as, for example, the human serum albumin (hHSA) signal sequence which works well in yeast, insect, or mammalian host cells and the tissue plasminogen activator pre/pro sequence which has been demonstrated to be functional in insect and mammalian cells (Tan et al., (2002) *Protein Eng.* 15:337). The choice of expression host can be made based on these and other factors, such as regulatory and safety considerations, production costs and the need and methods for purification. Thus, the vector system must be compatible with the host cell used.

Prokaryotic and eukaryotic cells containing the vectors are provided. Such cells include bacterial cells, yeast cells, fungal cells, Archaea, plant cells, insect cells and animal cells. The cells are used to produce a protein thereof by growing the above-described cells under conditions whereby the encoded protein is expressed by the cell, and recovering the expressed protein. For example, the protein can be secreted into the medium.

Expression in eukaryotic hosts can include expression in yeasts such as *Saccharomyces cerevisiae* and *Pichia pastoris*, insect cells such as *Drosophila* cells and lepidopteran cells, plants and plant cells such as tobacco, corn, rice, algae, and Lemna. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs. Eukaryotic expression, such as mammalian expression systems, is generally employed when glycosylation of a protein is desired, such as for expressing or producing a glycosylated hyaluronan-degrading enzyme (e.g., soluble hyaluronidase, such as PH20).

Prokaryotes, especially *E. coli*, provide a system for producing large amounts of proteins, such as reassembled antibodies or portions thereof, and are particularly desired in applications of expression and purification of proteins. Transformation of *E. coli* is a simple and rapid technique well-known to those of skill in the art. *E. coli* host strains for high throughput expression include, but are not limited to, BL21 (EMD Biosciences) and LMG194 (ATCC). An exemplary *E. coli* host strain is BL21. Vectors for high throughput expression include, but are not limited to, pBR322 and pUC vectors.

Recombinant molecules can be introduced into host cells via, for example, transformation, transfection, infection, electroporation and sonoporation, so that many copies of the gene sequence are generated. For example, the vectors can be transfected and expressed in host cells. Generally, standard transfection methods are used to produce bacterial, mammalian, yeast, or insect cell lines that express large quantity of antibody chains, which are then purified using standard techniques (see e.g., Colley et al. (1989) *J. Biol. Chem.*, 264:17619-17622; Guide to Protein Purification, in Methods in Enzymology, vol. 182 (Deutscher, ed.), 1990).

Transformation of eukaryotic and prokaryotic cells are performed according to standard techniques (see, e.g., Morrison (1977) *J. Bact.* 132:349-351; Clark-Curtiss and Curtiss (1983) *Methods in Enzymology*, 101, 347-362). For example, any of the well-known procedures for introducing foreign nucleotide sequences into host cells can be used. These include the use of calcium phosphate transfection, polybrene, protoplast fusion, electroporation, biolistics, liposomes, microinjection, plasma vectors, viral vectors and any other the other well-known methods for introducing cloned genomic DNA, cDNA, synthetic DNA or other foreign genetic material into a host cell.

Generally, for purposes of expressing an antibody, host cells are transfected with a first vector encoding at least a $V_H$ chain and a second vector encoding at least a $V_L$ chain. Thus, it is only necessary that the particular genetic engineering procedure used be capable of successfully introducing at least both genes into the host cell capable of expressing antibody polypeptide, or modified form thereof. The first and second expression vectors are generally co-transfected into host cells, typically at a 1:1 ratio. Expression can be in any cell expression system known to one of skill in the art. For example, host cells include cells that do not otherwise produce immunoglobulin protein, to obtain the synthesis of antibodies in the recombinant host cells. For example, host cells include, but are not limited to simian COS cells, Chinese hamster ovary (CHO) cells, 293FS cells, HEK293-6E cells, NSO cells or other myeloma cells. Other expression vectors and host cells are described herein.

Upon expression, antibody heavy and light chains pair by disulfide bond to form a full-length antibody or fragments thereof. For example, for expression of a full-length Ig, sequences encoding the $V_H$-$C_H1$-hinge-$C_H2$-$C_H3$ can be cloned into a first expression vector and sequences encoding the $V_L$-$C_L$ domains can be cloned into a second expression vector. Upon co-expression of the first expression vector, encoding the $V_H$-$C_H1$-hinge-$C_H2$-$C_H3$ domains, and the second expression vector, encoding the $V_L$-$C_L$ domains, a full-length antibody is expressed. In another example, to generate a Fab, sequences encoding the $V_H$-$C_H1$ can be cloned into a first expression vector and sequences encoding the $V_L$-$C_L$ domains can be cloned into a second expression vector. The heavy chain pairs with a light chain and a Fab monomer is generated. Sequences of $C_H1$, hinge, $C_H2$ and/or $C_H3$ of various IgG sub-types are known to one of skill in the art (see, e.g., U.S. Publication No. 20080248028). Similarly, sequences of $C_L$, lambda or kappa, also are known (see, e.g., U.S. Publication No. 20080248028). Examples of such sequences are provided herein.

a. Prokaryotic Cells

Prokaryotes, especially *E. coli*, provide a system for producing large amounts of proteins. Transformation of *E. coli* is a simple and rapid technique well-known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm.

Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well-known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the Arxula adeninivorans glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing proteins. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin and p10 promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frupperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. To generate baculovirus recombinants capable of expressing human antibodies, a dual-expression transfer, such as pAcUW51 (PharMingen) can be utilized. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Also, cell lines such as Sf9 derived cells from *Spodoptera frugiperda* and TN derived cells from *Trichoplusia ni* can be used for expression. The baculovirus immediate early gene promoter IE1 can be used to induce consistent levels of expression. Typical expression vectors include the pIE1-3 and pI31-4 transfer vectors (Novagen). Expression vectors are typically maintained by the use of selectable markers such as neomycin and hygromycin.

d. Mammalian Cells

Mammalian expression systems can be used to express proteins. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control.

Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. For expressing antibodies, a $NEO^R$/G418 system, a dihydrofolate reductase (DHFR) system or a glutamine synthetase (GS) system can be used. The GS system uses joint expression vectors, such as pEE12/pEE6, to express both heavy chain and light chain. Fusion with cell surface signaling molecules such as TCR-ζ and Fc$_ε$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO—S cells (Invitrogen, Carlsbad, Calif., cat #11619-012) and the serum free EBNA-1 cell line (Pham et al., (2003) *Biotechnol. Bioeng.* 84:332-342). Cell lines also are available that are adapted to grow in special media optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements.

Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters.

Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteins. Because plants have different glycosylation patterns than mammalian cells, this can influence the choice of protein produced in these hosts.

4. Purification Techniques

Method for purification of proteins from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

When proteins are expressed by transformed bacteria in large amounts, typically after promoter induction, although expression can be constitutive, the polypeptides can form insoluble aggregates. There are several protocols that are suitable for purification of polypeptide inclusion bodies known to one of skill in the art. Numerous variations will be apparent to those of skill in the art.

For example, in one method, the cell suspension is generally centrifuged and the pellet containing the inclusion bodies resuspended in buffer which does not dissolve but washes the inclusion bodies, e.g., 20 mM Tris-HCl (pH 7.2), 1 mM EDTA, 150 mM NaCl and 2% Triton-X 100, a non-ionic detergent. It can be necessary to repeat the wash step to remove as much cellular debris as possible. The remaining pellet of inclusion bodies can be resuspended in an appropriate buffer (e.g., 20 mM sodium phosphate, pH 6.8, 150 mM NaCl). Other appropriate buffers are apparent to those of skill in the art.

Alternatively, proteins can be purified from bacteria periplasm. Where the protein is exported into the periplasm of the bacteria, the periplasmic fraction of the bacteria can be isolated by cold osmotic shock in addition to other methods known to those of skill in the art. For example, in one method, to isolate recombinant polypeptides from the periplasm, the bacterial cells are centrifuged to form a pellet. The pellet can be resuspended in a suitable buffer containing 20% sucrose. To lyse the cells, the bacteria can be centrifuged and the pellet resuspended in ice-cold 5 mM $MgSO_4$ and kept in an ice bath for approximately 10 minutes. The cell suspension is centrifuged and the supernatant decanted and saved. Recombinant proteins present in the supernatant can be separated from the host proteins by standard separation techniques well-known to those of skill in the art, such as the separation techniques described herein. These methods include, but are not limited to, the following steps: solubility fractionation, size differential filtration, and column chromatography.

Proteins can be purified using standard protein purification techniques known in the art. Such methods include, but are not limited to, SDS-PAGE, size fraction and size exclusion chromatography, ammonium sulfate precipitation and ionic exchange chromatography, such as anion exchange chromatography. For example, affinity purification techniques can be utilized to improve the efficiency and purity of the preparations. For example, antibodies, receptors and other molecules that bind hyaluronidase enzymes can be used in affinity purification. Expression constructs also can be engineered to add an affinity tag to a protein such as a myc epitope, GST fusion or $His_6$ and affinity purified with myc antibody, glutathione resin and Ni-resin, respectively. Such tags can aid in affinity purification methods.

Affinity purification techniques also can be used for purification of antibodies. For example, the anti-immune checkpoint protein antibodies provided herein can be purified by using column chromatography, wherein a solid support column material is linked to Protein G, a cell surface-associated protein from *Streptococcus*, that binds immunoglobulins with high affinity. In other examples, the anti-immune checkpoint protein antibodies can be purified by column chromatography, wherein a solid support column material is linked to Protein A, a cell surface-associated protein from *Staphylococcus* that binds immunoglobulins, such as IgG antibodies, with high affinity (see, e.g., Liu et al. (2010) *MAbs* 2(5):480-499). Other immunoglobulin-binding bacterial proteins that can be used to purify the anti-immune checkpoint protein antibodies provided herein include Protein A/G, a recombinant fusion protein that combines the IgG binding domains of Protein A and Protein G; and Protein L, a surface protein from *Peptostreptococcus* (Bjorck (1988) *J. Immunol.*, 140(4):1194-1197; Kastern, et al. (1992) J. Biol. Chem. 267(18):12820-12825; Eliasson et al. (1988) *J. Biol. Chem.* 263:4323-4327).

Purity can be assessed by any method known in the art including gel electrophoresis and staining and spectrophotometric techniques. The proteins can be purified to 60%, 70%, 80% purity and typically at least 90%, 91%, 92%, 93%, 94%, 95%, 96%, 97%, 98% or 99% purity. Purity can be assessed by standard methods such as by SDS-PAGE and coomassie staining. Once suitable proteins are obtained, they may be tested for activity. For example, an antibody can be tested for binding activity by any method known in the art, such as, but not limited to, ELISA, Western blotting, or surface plasmon resonance. A hyaluronan-degrading enzyme, such as a soluble hyaluronidase or PH20 can be tested for hyaluronidase activity. A purified hyaluronan-degrading enzyme typically has a specific activity of at least 70,000 to 100,000 Units/mg, for example, about 120,000 Units/mg. The specific activity can vary upon modification, such as with a polymer. For example, a polymer-conjugated hyaluronan-degrading enzyme, such as a polymer-conjugated soluble hyaluronidase (e.g., PEGPH20) can have a specific activity of 25,000 to 60,000 Units/mg, for example, about 35,000 Units/mg.

5. PEGylation of Hyaluronan-Degrading Enzyme Polypeptides

Polyethylene glycol (PEG) has been widely used in biomaterials, biotechnology and medicine primarily because PEG is a biocompatible, nontoxic, water-soluble polymer that is typically nonimmunogenic (Zhao and Harris, *ACS Symposium* Series 680: 458-72, 1997). In the area of drug delivery, PEG derivatives have been widely used in covalent attachment (i.e., "PEGylation") to proteins to reduce immunogenicity, proteolysis and kidney clearance and to enhance solubility (Zalipsky, *Adv. Drug Del. Rev.* 16:157-82, 1995). Similarly, PEG has been attached to low molecular weight, relatively hydrophobic drugs to enhance solubility, reduce toxicity and alter biodistribution. Typically, PEGylated drugs are injected as solutions.

A closely related application is synthesis of crosslinked degradable PEG networks or formulations for use in drug delivery since much of the same chemistry used in design of degradable, soluble drug carriers can also be used in design of degradable gels (Sawhney et al., *Macromolecules* 26: 581-87, 1993). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al., *Eur. Polym J* 32:785-790, 1996). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). In addition, complexes of complementary polymers have been formed from both homopolymers and copolymers.

Numerous reagents for PEGylation have been described in the art. Such reagents include, but are not limited to, N-hydroxysuccinimidyl (NHS) activated PEG; succinimidyl mPEG mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG; mPEG-benzotriazole carbonate, propionaldehyde PEG; mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. Nos. 5,672,662; 5,932,462; 6,495,659; 6,737,505; 4,002,531; 4,179,337; 5,122,614; 5,324,844; 5,446,090; 5,612,460; 5,643,575; 5,766,581; 5,795,569; 5,808,096; 5,900,461; 5,919,455; 5,985,263; 5,990,237; 6,113,906; 6,214,966; 6,258,351; 6,340,742; 6,413,507; 6,420,339; U.S. 6,437,025; U.S. Pat. Nos. 6,448,369; 6,461,802; 6,828,401; 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO0500360; U.S. 2005/0114037; U.S. 2005/0171328; U.S. 2005/0209416; EP 1064951; European Patent No. EP 0822199; and International Patent Publication Nos. WO 01076640; WO 0002017; WO 0249673; WO 9428024; and WO 0187925).

In one example, the polyethylene glycol has a molecular weight ranging from about 3 kD to about 50 kD, and typically from about 5 kD to about 30 kD. Covalent attachment of the PEG to the drug (known as "PEGylation") can be accomplished by known chemical synthesis techniques. For example, the PEGylation of protein can be accomplished by reacting NETS-activated PEG with the protein under suitable reaction conditions.

While numerous reactions have been described for PEGylation, those that are most generally applicable confer directionality, utilize mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatized PEG more susceptible to nucleophilic attack. The attacking nucleophile is usually the epsilon-amino group of a lysyl residue, but other amines also can react (e.g., the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan-degrading enzyme and reduced in the presence of NaCNBH$_3$. More specifically, PEGylated CMP sugars can be reacted with a hyaluronan-degrading enzyme in the presence of appropriate glycosyl-transferases. One technique is the "PEGylation" technique where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e., pharmaceuticals) the typical potential immune response is an IgG and/or IgM response, while polypeptides which are inhaled through the respiratory system (i.e., industrial polypeptide) potentially can cause an IgE response (i.e., allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Typically, to make the PEGylated hyaluronan-degrading enzymes provided herein, including the PEGylated hyaluronidases, PEG moieties are conjugated, via covalent attachment, to the polypeptides. Techniques for PEGylation include, but are not limited to, specialized linkers and coupling chemistries (see e.g., Roberts et al., *Adv. Drug*

Deliv. Rev. 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.,* 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. Patent Publication No. 2006/0104968).

As an exemplary illustration of the PEGylation of an illustrative method for making PEGylated hyaluronan-degrading enzymes, such as PEGylated hyaluronidases, PEG aldehydes, succinimides and carbonates have each been applied to conjugate PEG moieties, typically succinimidyl PEGs, to rHuPH20. For example, rHuPH20 has been conjugated with exemplary succinimidyl monoPEG (mPEG) reagents including mPEG-Succinimidyl Propionates (mPEG-SPA), mPEG-Succinimidyl Butanoates (mPEG-SBA), and (for attaching "branched" PEGs) mPEG2-N-Hydroxylsuccinimide. These PEGylated succinimidyl esters contain different length carbon backbones between the PEG group and the activated cross-linker, and either a single or branched PEG group. These differences can be used, for example, to provide for different reaction kinetics and to potentially restrict sites available for PEG attachment to rHuPH20 during the conjugation process.

Succinimidyl PEGs (as above) comprising either linear or branched PEGs can be conjugated to rHuPH20. PEGs can used to generate rHuPH20s reproducibly containing molecules having, on the average, between about three to six or three to six PEG molecules per hyaluronidase. Such PEGylated rHuPH20 compositions can be readily purified to yield compositions having specific activities of approximately 25,000 or 30,000 Unit/mg protein hyaluronidase activity, and being substantially free of non-PEGylated rHuPH20 (less than 5% non-PEGylated).

Using various PEG reagents, exemplary versions of hyaluronan-degrading enzymes, in particular soluble human recombinant hyaluronidases (e.g., rHuPH20), can be prepared, for example, using mPEG-SBA (30 kD), mPEG-SMB (30 kD), and branched versions based on mPEG2-NHS (40 kD) and mPEG2-NHS (60 kD). PEGylated versions of rHuPH20 have been generated using NHS chemistries, as well as carbonates, and aldehydes, using each of the following reagents: mPEG2-NHS-40K branched, mPEG-NHS-10K branched, mPEG-NHS-20K branched, mPEG2-NHS-60K branched; mPEG-SBA-5K, mPEG-SBA-20K, mPEG-SBA-30K; mPEG-SMB-20K, mPEG-SMB-30K; mPEG-butyraldehyde; mPEG-SPA-20K, mPEG-SPA-30K; and PEG-NHS-5K-biotin. PEGylated hyaluronidases have also been prepared using PEG reagents available from Dowpharma, a division of Dow Chemical Corporation; including hyaluronidases PEGylated with Dowpharma's p-nitrophenyl-carbonate PEG (30 kDa) and with propionaldehyde PEG (30 kDa).

In one example, the PEGylation includes conjugation of mPEG-SBA, for example, mPEG-SBA-30K (having a molecular weight of about 30 kDa) or another succinimidyl esters of PEG butanoic acid derivative, to a soluble hyaluronidase. Succinimidyl esters of PEG butanoic acid derivatives, such as mPEG-SBA-30K readily couple to amino groups of proteins. For example, covalent conjugation of m-PEG-SBA-30K and rHuPH20 (which is approximately 60 KDa in size) provides stable amide bonds between rHuPH20 and mPEG as shown in Scheme 1, below.

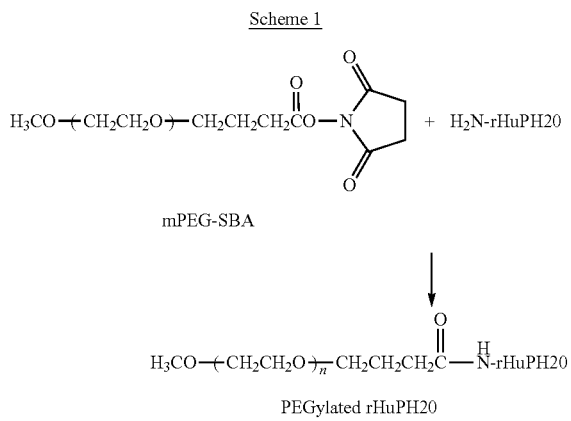

Scheme 1

Typically, the mPEG-SBA-30K or other PEG is added to the hyaluronan-degrading enzyme, in some instances a hyaluronidase, at a PEG:polypeptide molar ratio of 10:1 in a suitable buffer, e.g., 130 mM NaCl/10 mM HEPES at pH 6.8 or 70 mM phosphate buffer, pH 7, followed by sterilization, e.g., sterile filtration, and continued conjugation, for example, with stirring, overnight at 4° C. in a cold room. In one example, the conjugated PEG-hyaluronan-degrading enzyme is concentrated and buffer-exchanged.

Other methods of coupling succinimidyl esters of PEG butanoic acid derivatives, such as mPEG-SBA-30K are known in the art (see, e.g., U.S. Pat. Nos. 5,672,662; 6,737,505; and U.S. 2004/0235734). For example, a polypeptide, such as a hyaluronan-degrading enzyme (e.g., a hyaluronidase), can be coupled to an NHS activated PEG derivative by reaction in a borate buffer (0.1 M, pH 8.0) for one hour at 4° C. The resulting PEGylated protein can be purified by ultrafiltration. Alternatively, PEGylation of a bovine alkaline phosphatase can be accomplished by mixing the phosphatase with mPEG-SBA in a buffer containing 0.2 M sodium phosphate and 0.5 M NaCl (pH 7.5) at 4° C. for 30 minutes. Unreacted PEG can be removed by ultrafiltration. Another method reacts polypeptide with mPEG-SBA in deionized water to which triethylamine is added to raise the pH to 7.2-9. The resulting mixture is stirred at room temperature for several hours to complete the PEGylation.

Methods for PEGylation of hyaluronan degrading polypeptides, including, for example, animal-derived hyaluronidases and bacterial hyaluronan-degrading enzymes, are known to one of skill in the art. See, for example, European Patent No. EP 0400472, which describes the PEGylation of bovine testes hyaluronidase and chondroitin ABC lyase. Also, U.S. Publication No. 2006014968 describes PEGylation of a human hyaluronidase derived from human PH20. For example, the PEGylated hyaluronan-degrading enzyme generally contains at least 3 PEG moieties per molecule. For example, the hyaluronan-degrading enzyme can have a PEG to protein molar ratio between 5:1 and 9:1, for example, 7:1.

E. Pharmaceutical Compositions and Formulations

Provided herein are compositions or combinations of an anti-hyaluronan agent and an immune checkpoint inhibitor agent. For example, provided herein are compositions or combinations of a polymer-conjugated hyaluronan-degrading enzyme and an immune checkpoint inhibitor agent, such as an anti-immune checkpoint protein antibody, such as an anti-CTLA4 or anti-PD-1 antibody, formulation. The anti-immune checkpoint protein agent, such as an anti-immune checkpoint protein antibody, formulation can be co-formulated or co-administered with compositions containing an anti-hyaluronan agent, such as a hyaluronan-degrading enzyme. Typically, the anti-hyaluronan agent, such as a polymer-conjugated hyaluronan-degrading enzyme, can be provided as a combination of separate compositions that are administered separately, for example, for pre-administration of the hyaluronan-degrading enzyme as described herein. The compositions or combination of compositions can be formulated for parenteral delivery (i.e., for systemic delivery). For example, the compositions or combination of compositions are formulated for subcutaneous delivery or for intravenous delivery.

The compositions and combinations can be formulated for single dosage administration or for multiple dosage administration. The agents can be formulated for direct administration. The compositions can be provided as a liquid or lyophilized formulation.

The compounds can be formulated into suitable pharmaceutical preparations such as solutions, suspensions, tablets, dispersible tablets, pills, capsules, powders, sustained release formulations or elixirs, for oral administrate, as well as transdermal patch preparation and dry powder inhalers. Typically, the compounds are formulated into pharmaceutical compositions using techniques and procedures well-known in the art (see e.g., Ansel *Introduction to Pharmaceutical Dosage Forms*, Fourth Edition, 1985, 126). Generally, the mode of formulation is a function of the route of administration. The compositions can be co-formulated or provided as separate compositions.

Generally, the compositions are formulated in lyophilized or liquid form. Where the compositions are provided in lyophilized form they can be reconstituted just prior to use by an appropriate buffer, for example, a sterile saline solution. The compositions can be provided together or separately. For purposes herein, such compositions typically are provided separately. The anti-hyaluronan agent, for example, the hyaluronan-degrading enzyme (e.g., a soluble hyaluronidase, such as a PH20) and an anti-immune checkpoint protein agent, such as an anti-immune checkpoint protein antibody, can be packaged as separate compositions for administration together, sequentially or intermittently. The combinations can be packaged as a kit.

Compositions can be formulated for administration by any route known to those of skill in the art including intramuscular, intravenous, intradermal, intralesional, intraperitoneal injection, subcutaneous, intratumoral, epidural, nasal, oral, vaginal, rectal, topical, local, otic, inhalational, buccal (e.g., sublingual), and transdermal administration or any route. Other modes of administration also are contemplated. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition. Administration also can include controlled release systems including controlled release formulations and device controlled release, such as by means of a pump.

The most suitable route in any given case depends on a variety of factors, such as the nature, progress, and severity of the cancer being treated and the particular composition which is used. For purposes herein, it is desired that an anti-hyaluronan agent, such as a hyaluronan-degrading enzyme (e.g., a soluble hyaluronidase, such as a PH20) and an anti-immune checkpoint protein agent (e.g., anti-immune checkpoint protein antibody) are administered such that a pharmaceutically available amount or level exists in the plasma. For example, compositions are administered systemically, for example, via intravenous administration. Subcutaneous methods also can be employed, although increased absorption times can be necessary to ensure equivalent bioavailability compared to intravenous methods. The agents, such as a hyaluronan-degrading enzyme and anti-immune checkpoint protein agent, such as an anti-CTLA4 or anti-PD-1 antibody can be administered by different routes of administration. Pharmaceutical compositions can be formulated in dosage forms appropriate for each route of administration.

Administration methods can be employed to decrease the exposure of hyaluronan-degrading enzymes, e.g., soluble hyaluronidases, and other molecules to degradative processes, such as proteolytic degradation and immunological intervention via antigenic and immunogenic responses. Examples of such methods include local administration at the site of treatment or continuous infusion of the anti-hyaluronic agent.

1. Formulations

Pharmaceutically acceptable compositions are prepared in view of approvals for a regulatory agency or other agency prepared in accordance with generally recognized pharmacopeia for use in animals and in humans. Compositions can take the form of solutions, suspensions, emulsion, tablets, pills, capsules, powders, and sustained release formulations. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. The formulation should suit the mode of administration.

Pharmaceutical compositions can include carriers such as a diluent, adjuvant, excipient, or vehicle with which an enzyme or activator is administered. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, cyclodextrin derivatives, sorbitan monolaurate, triethanolamine sodium acetate, triethanolamine oleate, and other such agents.

In one example, pharmaceutical preparation can be in liquid form, for example, solutions, syrups or suspensions. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

Pharmaceutically and therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Unit dosage forms, include, but are not limited to, tablets, capsules, pills, powders, granules, sterile parenteral solutions or suspensions, and oral solutions or suspensions, and oil water emulsions containing suitable quantities of the compounds or pharmaceutically acceptable derivatives thereof. Unit dose forms can be contained ampoules and syringes or individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared.

Pharmaceutical composition can be formulated in dosage forms appropriate for each route of administration.

a. Injectables, Solutions and Emulsions

Parenteral administration, generally characterized by injection, either subcutaneously, intramuscularly, intratumorally, intravenously or intradermally is contemplated herein. Injectables can be prepared in conventional forms, either as liquid solutions or suspensions, solid forms suitable for solution or suspension in liquid prior to injection, or as emulsions. Suitable excipients are, for example, water, saline, dextrose, glycerol or ethanol. In addition, if desired, the pharmaceutical compositions to be administered may also contain an activator in the form of a solvent such as pH buffering agents, metal ion salts, or other such buffers. The pharmaceutical compositions also may contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins. Implantation of a slow-release or sustained-release system, such that a constant level of dosage is maintained (see, e.g., U.S. Pat. No. 3,710,795) also is contemplated herein. The percentage of active compound contained in such parenteral compositions is highly dependent on the specific nature thereof, as well as the activity of the compound and the needs of the subject.

Injectables are designed for local and systemic administration. For purposes herein, local administration is desired for direct administration to the affected interstitium associated with accumulated or excess hyaluronan. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions may be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride.

Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

If administered intravenously, suitable carriers include physiological saline or phosphate buffered saline (PBS), and solutions containing thickening and solubilizing agents, such as glucose, polyethylene glycol, and polypropylene glycol and mixtures thereof.

The concentration of the pharmaceutically active compound is adjusted so that an injection provides an effective amount to produce the desired pharmacological effect. The exact dose depends on the age, weight and condition of the patient or animal as is known in the art. The unit-dose parenteral preparations are packaged in an ampoule, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art.

b. Lyophilized Powders

Compositions provided herein include lyophilized powders, which can be reconstituted for administration as solutions, emulsions and other mixtures. They may also be reconstituted and formulated as solids or gels. The lyophilized powders can be prepared from any of the solutions described above.

The sterile, lyophilized powder is prepared by dissolving a compound of an anti-hyaluronan agent that is a hyaluronan-degrading enzyme, such as a soluble hyaluronidase, and/or anti-immune checkpoint protein agent, such as an anti-immune checkpoint protein antibody (e.g., an anti-CTLA4 or anti-PD-1 antibody) in a buffer solution. The buffer solution may contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbitol, fructose, corn syrup, xylitol, glycerin, glucose, sucrose or other suitable agent, in a suitable buffer, such as citrate, sodium or potassium phosphate or other such buffer known to those of skill in the art. Then, a selected enzyme is added to the resulting mixture, and stirred until it dissolves. The resulting mixture is sterile filtered or treated to remove particulates and to insure sterility, and apportioned into vials for lyophilization. Each vial will contain a single dosage (1 mg-1 g, generally 1-100 mg, such as 1-5 mg) or multiple dosages of the compound. The lyophilized powder can be stored under appropriate conditions, such as at about 4° C. to room temperature.

Reconstitution of this lyophilized powder with a buffer solution provides a formulation for use in parenteral administration. The precise amount depends upon the indication treated and selected compound. Such amount can be empirically determined.

c. Compositions for Other Routes of Administration

Depending upon the condition treated other routes of administration, such as topical application, transdermal patches, oral and rectal administration, also are contemplated herein. For example, topical mixtures are prepared as described for the local and systemic administration. The resulting mixture may be a solution, suspension, emulsions or the like and are formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The compounds may be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients also can be administered.

Formulations suitable for transdermal administration are provided. They can be provided in any suitable format, such as discrete patches adapted to remain in intimate contact with the epidermis of the recipient for a prolonged period of time. Such patches contain the active compound in optionally buffered aqueous solution of, for example, 0.1 to 0.2 M concentration with respect to the active compound. Formulations suitable for transdermal administration also can be delivered by iontophoresis (see, e.g., *Pharmaceutical Research* 3(6), 318 (1986)) and typically take the form of an optionally buffered aqueous solution of the active compound.

Pharmaceutical dosage forms for rectal administration are rectal suppositories, capsules and tablets for systemic effect. Rectal suppositories include solid bodies for insertion into the rectum which melt or soften at body temperature releasing one or more pharmacologically or therapeutically active ingredients. Pharmaceutically acceptable substances utilized in rectal suppositories are bases or vehicles and agents to raise the melting point. Examples of bases include cocoa butter (theobroma oil), glycerin-gelatin, carbowax (polyoxyethylene glycol) and appropriate mixtures of mono-, di- and triglycerides of fatty acids. Combinations of the various bases may be used. Agents to raise the melting point of suppositories include spermaceti and wax. Rectal suppositories may be prepared either by the compressed method or by molding. The typical weight of a rectal suppository is about 2 to 3 g. Formulations suitable for rectal administration can be provided as unit dose suppositories. These can be prepared by admixing the active compound with one or more conventional solid carriers, for example, cocoa butter, and then shaping the resulting mixture. Tablets and capsules for rectal administration are manufactured using the same pharmaceutically acceptable substance and by the same methods as for formulations for oral administration.

For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well-known in the art.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Pharmaceutical compositions also can be administered by controlled release formulations and/or delivery devices (see, e.g., in U.S. Pat. Nos. 3,536,809; 3,598,123; 3,630,200; 3,845,770; 3,847,770; 3,916,899; 4,008,719; 4,687,660; 4,769,027; 5,059,595; 5,073,543; 5,120,548; 5,354,556; 5,591,767; 5,639,476; 5,674,533 and 5,733,566).

Various delivery systems are known and can be used to administer selected compositions, such as but not limited to, encapsulation in liposomes, microparticles, microcapsules, recombinant cells capable of expressing the compound, receptor mediated endocytosis, and delivery of nucleic acid molecules encoding a soluble hyaluronidase or other agent such as retrovirus delivery systems.

Hence, in certain embodiments, liposomes and/or nanoparticles also can be employed with administration of compositions herein. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 µm. Sonication of MLVs results in the formation of small unilamellar vesicles (SUVs) with diameters in the range of 200 to 500 angstroms containing an aqueous solution in the core.

Phospholipids can form a variety of structures other than liposomes when dispersed in water, depending on the molar ratio of lipid to water. At low ratios, the liposomes form. Physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 μm) should be designed using polymers able to be degraded in vivo. Biodegradable polyalkyl-cyanoacrylate nanoparticles that meet these requirements are contemplated for use herein, and such particles can be easily made.

2. Formulation Amounts

The compositions can be formulated for single dosage administration or for multiple dosage administration. In some examples, the agents are formulated for direct administration.

a. Hyaluronan-Degrading Enzyme Formulations

In the compositions or combinations of compositions provided herein wherein the anti-hyaluronan agent is a hyaluronan-degrading enzyme such as a polymer-conjugated hyaluronan-degrading enzyme, the polymer-conjugated hyaluronan-degrading enzyme is formulated in an amount for direct administration in a range between or about between 0.5 μg to 50 mg, such as 100 μg to 1 mg, 1 mg to 20 mg, 100 μg to 5 mg, 0.5 μg to 1450 μg, 1 μg to 1000 μg, 5 μg to 1250 μg, 10 μg to 750 μg, 50 μg to 500 μg, 0.5 μg to 500 μg or 500 μg to 1450 μg. For example, the polymer-conjugated hyaluronan-degrading enzyme is formulated in an amount for direct administration in a range between or about between 15 Units (U) or 150 Units (U) to 60,000 Units per dose, 300 U to 30,000 U, 500 U to 25,000 U, 500 U to 10,000 U, 150 U to 15,000 U, 150 U to 5000 U, 500 U to 1000 U, 5000 U to 45,000 U 10,000 U to 50,000 U or 20,000 U to 60,000 U, for example at least or about at least or about or 15 U, 50 U, 100 U, 200 U, 300 U; 400 U; 500 U; 600 U; 700 U; 800 U; 900 U; 1,000 U; 1250 U; 1500 U; 2000 U; 3000 U; 4000 U; 5,000 U; 6,000 U; 7,000 U; 8,000 U; 9,000 U; 10,000 U; 20,000 U; 30,000 U; 40,000 U; or 50,000 U.

The polymer-conjugated hyaluronan-degrading enzyme in the composition can be provided at a concentration of between or between about 10 U/mL to 15,000 U/mL, 10 U/mL to 5000 U/mL, 10 U/mL to 2000 U/mL, 10 U/mL to 1000 U/mL, 10 U/mL to 600 U/mL, 10 U/mL to 500 U/mL, 30 U/mL to 3000 U/mL, 30 U/mL to 1000 U/mL, 50 U/mL to 4000 U/mL, 100 U/mL to 2000 U/mL, 100 U/mL to 1000 U/mL, 300 U/mL to 2000 U/mL, 600 U/mL to 2000 U/mL, 600 U/mL to 1000 U/mL, 1000 U/mL to 15,000 U/mL, 100 U/mL to 5,000 U/mL, 500 U/mL to 5,000 U/mL or 100 U/mL to 400 U/mL, for example at least or at least about or about or 30 U/mL, 35 U/mL, 40 U/mL, 50 U/mL, 100 U/mL, 150 U/mL, 200 U/mL, 300 U/mL, 400 U/mL, 500 U/mL, 600 U/mL, 700 U/mL, 800 U/mL, 900 U/mL, 1000 U/mL, 2000 Units/mL, 3000 U/mL, 4000 U/mL, 5000 U/mL, 6000 U/mL, 7000 U/mL, 8000 U/mL, 9000 U/mL, 10,000 U/mL, 11,000 U/mL, 12,000 U/mL, or 12,800 U/mL.

The polymer-conjugated hyaluronan-degrading enzyme can be provided at a concentration that is between or between about 0.1 μg/mL to 10 mg/mL, such as 1 μg/mL to 5 mg/mL or 1 mg/mL to 5 mg/mL. In some examples, the polymer-conjugated hyaluronan-degrading enzyme in the composition can be provided at a concentration of between or between about 0.1 μg/mL to 100 μg/mL, 0.1 μg/mL to 50 μg/mL, 0.1 μg/mL to 20 μg/mL, 1 μg/mL to 100 μg/mL, 1 μg/mL to 50 μg/mL, 1 μg/mL to 20 μg/mL, 20 μg/mL to 100 μg/mL, 20 μg/mL t0 50 μg/mL or 50 μg/mL to 100 μg/mL, for example at least or at least about or about 0.1 μg/mL, 1 μg/mL, 5 μg/mL, 10 μg/mL, 20 μg/mL, 30 μg/mL, 40 μg/mL, 50 μg/mL, 60 μg/mL, 70 μg/mL, 80 μg/mL, 90 μg/mL, or 100 μg/mL.

The volume of the composition can be 0.5 mL to 1000 mL, such as 0.5 mL to 100 mL, 0.5 mL to 10 mL, 1 mL to 500 mL, 1 mL to 10 mL, such as at least or about at least or about or 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL, 50 mL or more. The composition is generally formulated so that the polymer-conjugated hyaluronan-degrading enzyme is not administered in volumes greater than about 50 mL, and typically is administered in a volume of 5-30 mL, generally in a volume that is not greater than about 10 mL. For larger volumes, the time of infusion can be adapted to facilitate delivery of the larger volume. For example, infusion time can be at least 1 minute, 5 minutes, 10 minutes, 20 minutes, 30 minutes, 40 minutes, 50 minutes, 1 hour or more.

For example, a standard stabilized formulation of a polymer-conjugated hyaluronan-degrading enzyme, such as a polymer-conjugated soluble hyaluronidase as provided herein, is formulated with one or more of EDTA, NaCl, CaCl$_2$, histidine, lactose, albumin, Pluronic® F68, TWEEN® and/or other detergent or other similar agents. For example, compositions provided herein can contain one or more pH buffers (such as, for example, histidine, phosphate, or other buffers), or acidic buffer (such as acetate, citrate, pyruvate, Gly-HCl, succinate, lactate, maleate or other buffers), tonicity modifier (such as, for example, an amino acid, polyalcohol, NaCl, trehalose, other salts and/or sugars), stabilizer, chelating agent, such as ethylenediaminetetraacetate (EDTA) or calcium EDTA (CaEDTA), oxygen scavenger, such as methionine, ascorbic acid/ascorbate, citric acid/citrate, or albumin, and/or a preservative, such as preservative containing an aromatic ring (e.g., phenol or cresol).

Exemplary stabilizers that are useful for compositions containing a hyaluronan-degrading enzyme include detergents, such as polysorbates and proteins such as human serum albumin. Exemplary concentrations of serum albumin that are useful in the compositions herein include 0.1 mg/mL to 1 mg/mL, such as at least or at least about or about or 0.1 mg/mL, 0.2 mg/mL, 0.3 mg/mL, 0.4 mg/mL, 0.5 mg/mL, 0.6 mg/mL, 0.7 mg/mL, 0.8 mg/mL, 0.9 mg/mL or 1 mg/mL, but can be more or less.

Polysorbates also can be present in the compositions at, for example, concentrations of or about between 0.001% to 0.1%, such as at least about or at least or about or 0.001%, 0.002%, 0.003%, 0.004%, 0.005%, 0.006%, 00.007%, 0.008%, 0.009%, 0.01%, 0.02%, 0.03%, 0.04%, 0.05%, 0.06%, 0.07%, 0.08%, 0.09% or 0.1%.

A metal chelating agent, such as calcium EDTA (CaEDTA), also can be present, such as for example, at concentrations of between approximately 0.02 mM to 20 mM, such as at least about or at least or about or 0.02 mM, 0.04 mM, 0.06 mM, 0.08 mM, 0.1 mM, 0.2 mM, 0.3 mM, 0.4 mM, 0.5 mM, 0.6 mM, 0.7 mM, 0.8 mM, 0.9 mM, 1 mM, 5 mM, 10 mM, 15 mM, 20 mM or more.

The pH and the osmolarity of the compositions can be adjusted by one of skill in the art to optimize the conditions for the desired activity and stability of the composition. In some examples, the compositions provided herein have an osmolarity of between 100 mOsm/kg to 500 mOsm/kg, such as at least or at least about or at or about 100 mOsm/kg, 120 mOsm/kg, 140 mOsm/kg, 160 mOsm/kg, 180 mOsm/kg, 200 mOsm/kg, 220 mOsm/kg, 240 mOsm/kg, 260 mOsm/kg, 280 mOsm/kg, 300 mOsm/kg, 320 mOsm/kg, 340 mOsm/kg, 360 mOsm/kg, 380 mOsm/kg, 400 mOsm/kg, 420 mOsm/kg, 440 mOsm/kg, 460 mOsm/kg, 500 or more mOsm/kg, and a pH of between or between about 6 to 8, such as 6 to 7.4, for example at or about 6, 6.2, 6.4, 6.6, 6.8, 7, 7.2, 7.4, 7.6, 7.8 or 8.

Generally, NaCl is provided in formulations containing a hyaluronan-degrading enzyme herein, for example, in an amount that is or is about 100 mM to 150 mM or more. For example, an exemplary formulation can contain at or about 10 mM histidine and/or at or about 130 mM NaCl. Other formulations can contain in addition or alternatively lactose, for example, at or about 13 mg/mL. Additionally, an antibacterial or anti-fungal agent, including, but not limited to thiomersal, can be present in the formulation. Formulations can further contain Albumin, Pluronic® F68, TWEEN® and/or other detergent. The formulations are provided at a pH that is or is about 6.0 to 7.4, such as at least 6.0, 6.1, 6.2, 6.3, 6.4, 6.5, 6.6, 6.7, 6.8, 6.9, 7.0, 7.1, 7.2, 7.3 or 7.4, generally that is or is about pH 6.5. Concentrated formulations of a modified soluble hyaluronidase for use herein are generally diluted in a saline solution or other salt buffered solution prior administration to maintain the appropriate salt concentration.

b. Checkpoint Inhibitor Formulations

In the compositions or combinations of compositions provided herein, the immune checkpoint inhibitor is formulated in an amount for direct administration in a range between or between about 7.5 mg to about 5,000 mg, about 7.5 mg to about 1,500 mg, about 7.5 mg to about 750 mg, or about 22.5 to about 750 mg. In some examples, the immune checkpoint inhibitor can be formulated as a low dose formulation, for example, for more frequent administration. In such formulations, the immune checkpoint inhibitor is formulated for single dosage administration in an amount that is less than or less than about 1 mg, 500 µg, 400 µg, 300 µg, 200 µg, 100 µg, 50 µg, 30 µg, 20 µg, 10 µg, 5 µg or less than 1 µg. Thus, non-limiting amounts of immune checkpoint inhibitor that is formulated for direct administration include a dosage that is or is about 1 µg 5 µg, 10 µg, 20 µg, 30 µg, 50 µg, 100 µg, 200 µg, 250 µg, 500 µg, 1 mg, 5 mg, 7.5 mg, 10 mg, 20 mg, 22, 5 mg, 30 mg, 35 mg, 37.5 mg, 50 mg, 75 mg, 100 mg, 150 mg, 200 mg, 210 mg, 250 mg, 300 mg, 350 mg, 375 mg, 500 mg, 750 mg, 1000 mg, 1500 mg, 2000 mg, 2500 mg, 3000 mg, 3500 mg, 4000 mg, 4500 mg, or 5000 mg.

Formulations containing an immune checkpoint inhibitor, such as an anti-immune checkpoint protein antibody can be provided as a percentage of weight per volume. Such concentrations of an immune checkpoint inhibitor include, but are not limited to, a concentration that is or is about 0.01% to 99.5% w/v, such as 0.1% to 90% w/v, 0.1% to 70% w/v, 0.1% to 30% w/v, or 5% to 22% w/v. In examples, the immune checkpoint inhibitor in compositions can be provided at a concentration that is between or about between 0.5 mg/mL to 500 mg/mL, such as 0.5 mg/mL to 250 mg/mL, 0.5 mg/mL to 100 mg/mL, 0.5 mg/mL to 50 mg/mL, 0.5 mg/mL to 10 mg/mL, 0.5 mg/mL to 6 mg/mL, 0.5 mg/mL to 2 mg/mL, 2 mg/mL to 250 mg/mL, 2 mg/mL to 100 mg/mL, 2 mg/mL to 50 mg/mL, 2 mg/mL to 10 mg/mL, 2 mg/mL to 6 mg/mL, 6 mg/mL to 250 mg/mL, 6 mg/mL to 100 mg/mL, 6 mg/mL to 50 mg/mL, 6 mg/mL to 10 mg/mL, 10 mg/mL to 250 mg/mL, 10 mg/mL to 100 mg/mL, 10 mg/mL to 50 mg/mL, 50 mg/mL to 250 mg/mL, 50 mg/mL to 100 mg/mL, or 100 mg/mL to 250 mg/mL. For example, the immune checkpoint inhibitor can be provided in the composition at a concentration that is at least 0.5 mg/mL, 1 mg/mL, 2 mg/mL, 5 mg/mL, 6 mg/mL, 7 mg/mL, 8 mg/mL, 9 mg/mL, 10 mg/mL, 20 mg/mL, 30 mg/mL, 40 mg/mL, 50 mg/mL, 60 mg/mL, 70 mg/mL, 80 mg/mL, 90 mg/mL, 100 mg/mL, 120 mg/mL, 150 mg/mL, 180 mg/mL, 200 mg/mL, 220 mg/mL, 250 mg/mL or more. In some cases, the immune checkpoint inhibitor in the formulation is provided in an amount that is at least 1% (10 mg/mL) to 30% (300 mg/mL), for example, at least 1%, 2%, 3%, 4%, 5%, 6%, 7%, 8%, 9%, 10%, 11%, 12%, 13%, 14%, 15%, 16%, 17%, 18%, 19%, 20% 21%, 22%, 23%, 24%, 25%, 26%, 27%, 28%, 29%, 30%, or more.

The volume of the composition can be 0.5 mL to 1000 mL, such as 0.5 mL to 100 mL, 0.5 mL to 10 mL, 1 mL to 500 mL, 1 mL to 10 mL, such as at least or about at least or about or 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL, 50 mL, 60 mL, 70 mL, 80 mL, 90 mL or more. When administered, the composition can be administered by infusion. For larger volumes, the time of infusion can be adapted to facilitate delivery of the larger volume. For example, infusion time can be at least 1 minute, 5 minutes, 10 minutes, 20 minutes, 30 minutes, 40 minutes, 50 minutes, 1 hour, 2 hours or more.

The antibody preparations provided herein can be formulated as pharmaceutical compositions for single or multiple dosage use. Typically, the antibody is formulated in an amount such that it is ready to use and that no further dilution is necessary. Depending on whether the formulation is provided as a single or multiple dosage formulation, one of skill in the art can empirically determine the exact amount of antibody in the formulation.

It is understood that antibody formulations can contain other components, including carriers, polymers, lipids and other excipients. The dosages concentrations above are with respect to the antibody component, which is the active ingredient.

3. Packaging and Articles of Manufacture

Also provided are articles of manufacture containing packaging materials, any pharmaceutical composition or combination provided herein, and a label that indicates that the compositions and combinations are to be used for treatment of cancers, such as cancers characterized by solid tumors that have at least moderate to high HA phenotype. Exemplary articles of manufacture are containers including single chamber and dual chamber containers. The containers include, but are not limited to, tubes, bottles and syringes. The containers can further include a needle for subcutaneous administration.

In one example, the article of manufacture contains a pharmaceutical composition contains the anti-hyaluronan agent, such as the polymer-conjugated hyaluronan-degrading enzyme and immune checkpoint inhibitor (e.g., anti-immune checkpoint protein antibody), and no further agent or treatment. In another example, the article of manufacture contains pharmaceutical compositions containing the anti-hyaluronan agent (e.g., polymer-conjugated hyaluronan-degrading enzyme, such as PEGPH20), the immune checkpoint inhibitor (e.g., anti-immune checkpoint protein antibody) and a further therapeutic agent (e.g., a chemotherapeutic agent). In this example, the agents can be provided together or separately, for packaging as articles of manufacture.

The articles of manufacture provided herein contain packaging materials. Packaging materials for use in packaging pharmaceutical products are well-known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment.

The choice of package depends on the agents, and whether such compositions will be packaged together or separately. In general, the packaging is non-reactive with the compositions contained therein. In other examples, some of the components can be packaged as a mixture. In other examples, all components are packaged separately. Thus, for example, the components can be packaged as separate compositions that, upon mixing just prior to administration, can be directly administered together. Alternatively, the components can be packaged as separate compositions for administration separately.

The components can be packaged in a container. The components are separately packaged in the same container. Generally, examples of such containers include those that have an enclosed, defined space that contains the polymer-conjugated hyaluronan-degrading enzyme, and a separate enclosed, defined space containing the other components or component such that the subsequent areas are separated by a readily removable membrane which, upon removal, permits the components to mix, or which permits the components to be separately administered. Any container or other article of manufacture is contemplated, as long as the agents are separated from the other components prior to administration. For suitable embodiments see e.g., containers described in U.S. Pat. Nos. 3,539,794 and 5,171,081.

Selected compositions including articles of manufacture thereof also can be provided as kits. Kits can include a pharmaceutical composition described herein and an item for administration provided as an article of manufacture. The kit can, optionally, include instructions for application including dosages, dosing regimens and instructions for modes of administration. Kits also can include a pharmaceutical composition described herein and an item for diagnosis.

F. Methods of Monitoring and Assessing Activity, Bioavailability and Pharmacokinetics The agents in the compositions herein can be assessed for properties and activities related to their use in the combination therapy provided herein. The properties and activities can be related to biological activities, tumorigenic, and/or immunoresponsive activities. The assays can be performed in vitro or in vivo. The assays can be used to assess effects of agents, including effects of dose and route of administration.

1. Hyaluronidase Activity

Hyaluronidase activity can be assessed using methods well-known in the art. In particular, assays for hyaluronidase can be determined by measuring the amount of hyaluronic acid (hyaluronan, HA) that is degraded. Assays can include viscosimetric and turbidimetric methods (Daubenmerkl et al. (1957) Acta Pharmacol. et Toxicol, 13:1-11). Assays also can include ELISA, chromatography and colorimetry methods. Such assays are known to a skilled artisan. Hyaluronidase Reference Standard (USP), National Formulary (NF) Standard Hyaluronidase solution or International hyaluronidase reference standard, in which a unit of each is equivalent, can be used in an assay to ascertain the activity, in units, of any hyaluronidase.

A turbidimetric method of assessing hyaluronidase activity can include assay procedures described in the United States Pharmacopoeia XXIII-National Formulary by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc., Rockville, Md.).

For example, activity can be measured using a microturbidity assay. This is based on the formation of an insoluble precipitate when hyaluronic acid binds with serum albumin. The activity is measured by incubating hyaluronidase with sodium hyaluronate (hyaluronic acid) for a set period of time (e.g., 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity.

In another example, hyaluronidase activity is measured using a microtiter assay in which residual biotinylated hyaluronic acid is measured following incubation with hyaluronidase (see e.g., Frost and Stern (1997) Anal. Biochem. 251:263-269, U.S. Patent Publication No. 20050260186). The free carboxyl groups on the glucuronic acid residues of hyaluronic acid are biotinylated, and the biotinylated hyaluronic acid substrate is covalently couple to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidase activity also are known in the art and can be used in the methods herein (see e.g., Delpech et al., (1995) *Anal. Biochem.* 229:35-41; Takahashi et al., (2003) *Anal. Biochem.* 322:257-263).

The ability of hyaluronidase to act as a spreading or diffusing agent also can be assessed. For example, trypan blue dye can be injected subcutaneously with or without hyaluronidase into the lateral skin on each side of nude mice. The dye area is then measured, such as with a microcaliper, to determine the ability of hyaluronidase to act as a spreading agent (U.S. Patent No. 20060104968).

2. Immune Checkpoint Inhibitor Activity

The activity of an immune checkpoint inhibitor, such as an antibody, can be assessed using methods known in the art, including in vitro or in vivo methods. For example, in vitro assays can be performed to assess the ability of a checkpoint inhibitor to bind the target checkpoint molecule (e.g., CTLA4 or PD-1). Other in vitro assays can be utilized to assess other biological activities of immune checkpoint inhibitors, such as an antibody. For example, the ability of an immune checkpoint inhibitor (e.g., an antibody) to block immune checkpoints, and hence stimulate an immune response, can be assessed in cultured cells, such as T cell activation, expression of extracellular receptors, or secretion of cytokines. Such activities can be assessed using any method known in the art, including, but not limited to, ELISA, Western blot, Northern blot, immunofluorescence, immunohistochemistry, and flow cytometry to assess marker expression.

In particular examples, immune checkpoint inhibitors, such as anti-immune checkpoint protein antibodies, for example anti-CTLA4 or anti-PD-1 antibodies, can be assayed for the ability to bind to their immune checkpoint protein antigen, such as CTLA4 or PD-1. Immune checkpoint inhibitors, such as anti-immune checkpoint protein antibodies, can be assessed for their ability to bind an immune checkpoint protein by any method known to one of skill in the art. Assays to assess binding include, but are not limited to, solid support binding assays, solution binding assays or cell-based assays. Exemplary assays include, but are not limited to, surface plasmon resonance; bio-layer interferometry; immunoassays, such as western blots, radio-immunoassays, ELISA (enzyme linked immunosorbent assay), Meso Scale Discovery (MSD, Gaithersburg, Md.), "sandwich" immunoassays, immunoprecipitation assays, ELISPOT, precipitin reactions, gel diffusion precipitin reactions, immunodiffusion assays, agglutination assays, complement-fixation assays, immunoradiometric assays, fluorescent immunoassays, protein A immunoassays, immunofluorescence, immunohistochemistry, or immuno-electron microscopy; isothermal titration calorimetry (ITC); spectroscopic assays; and other assays to assess binding known to a skilled artisan.

Binding to the corresponding target immune checkpoint protein can be assessed, such as binding to CTLA4 or PD-1. Several of the immune checkpoint proteins described herein are receptors that are membrane bound. Such proteins can be expressed as a soluble protein, where the membrane-bound region, such as the transmembrane domain, of the protein is modified or removed, for example by proteolytic cleavage or by recombinant expression of the encoding nucleic acid, to remove the membrane association domain and render the protein soluble. Exemplary soluble forms of immune checkpoint proteins include peptides that correspond to the extracellular domain of the immune checkpoint protein, or portion thereof that is soluble and is recognized by the immune checkpoint inhibitor (e.g., anti-immune checkpoint protein antibody).

Binding assays can be performed in solution, suspension or on a solid support. For example, the immune checkpoint protein or fragment thereof can be immobilized to a solid support (e.g., a carbon or plastic surface, a tissue culture dish or chip) and contacted with the immune checkpoint inhibitor, such as an antibody or other binding agent. Unbound inhibitor (e.g., antibody) or target protein can be washed away and bound complexes can then be detected. Binding assays can be performed under conditions to reduce non-specific binding, such as by using a high ionic strength buffer (e.g., 0.3-0.4 M NaCl) with nonionic detergent (e.g., 0.1% Triton X-100 or Tween 20) and/or blocking proteins (e.g., bovine serum albumin or gelatin). Negative controls also can be included in such assays as a measure of background binding. Binding affinities can be determined using Scatchard analysis (Munson et al., (1980) *Anal. Biochem.*, 107:220), surface plasmon resonance, isothermal calorimetry, quantitative ELISA or other methods known to one of skill in the art (e.g., Liliom et al. (1991) *J Immunol Methods.* 143(1):119-25).

In some cases, binding can be assessed using cells that are known to express the target immune checkpoint protein (e.g., CTLA4 or PD-1). The cells can be cells that are generated by transient or stable transfection, cell lines or primary cells. For example, exemplary cell lines that express CTLA4 that can be used in cell based assays to screen CTLA-binding proteins, such as anti-CTLA4 antibodies, include, but are not limited to, colorectal adenocarcinoma cell lines HCT-8 (ATCC CCL-244), HT-29 (ATCC HTB-38), COLO 205 (ATCC CCL-222) and CACO-2 (ATCC HTB-37); breast carcinoma cell lines, MCF-7 (ATCC HTB-22), MDA-MB-231 (ATCC HTB-26), T-47D (ATCC HTB-133); lung carcinoma cell lines, CALU-1 (ATCC HTB-54), CALU-6 (ATCC HTB-56), A549 (ATCC CCL-185); the ovarian carcinoma cell line, SKOV-3 (ATCC HTB-77); and the uterine carcinoma cell line, C33A (ATCC HTB-31). Exemplary cell lines that express PD-1 that can be used in cell based assays to screen PD-1 inhibiting proteins, such as anti-PD-1 antibodies, include, but are not limited to, EL4 (ATCC TIB-39) and Jurkat cells (ATCC TIB-152).

Binding can be assessed using fluorescence activated cell sorting (FACS), immunohistochemistry or immunofluorescence. In addition to cell binding, an assay that assesses a functional activity of the immune checkpoint inhibitor (e.g., anti-immune checkpoint protein antibody) can be employed, including, but not limited to, assays to assess changes in T cell activation, changes in cellular morphology, and/or changes in transcriptional activation, such as cellular expression of a natural gene or a reporter gene.

Cells determined to be appropriate for a particular phenotypic assay (i.e., any cell described herein or known in the art to express a selected immune checkpoint protein) can be treated with an immune checkpoint inhibitor, such as an anti-immune checkpoint protein antibody, as well as control. In some examples, the immune checkpoint protein target is a receptor and the ligand, such as CD80 or CD86 (for CTLA4) or PD-L1 or PD-L2 (for PD-1), is included in the assay so that activation of the receptor is effected. At the end of the treatment period, treated and untreated cells can be analyzed by one or more methods described herein or known in the art. In some examples, activity of the immune checkpoint inhibitor provided herein can be assessed by measuring changes in cell morphology, cell proliferation, or signaling. Changes in morphology upon T cell activation are described in Wülfing et al., (1998) *Proc Natl Acad Sci USA.* 95(11):6302-6307.

Proliferation assays can be used to measure the activity of selected immune checkpoint inhibitors, such as anti-immune checkpoint protein antibodies. The assays can measure proliferation of cells that express a selected immune checkpoint protein upon treatment with an immune checkpoint inhibitor, such as an anti-CTLA4 or anti-PD-1 antibody, in the presence of ligand, such as CD80 or CD86 (for CTLA4) or PD-L1 or PD-L2 (for PD-1). Cells can be incubated for a sufficient time for cells to exhibit proliferation (such as, for example, 12 hours, or 1, 2, 3, 4, 5, 6, 7 days or longer). Cell proliferation can be measured by any method known in the art, including $^3$H-thymidine incorporation assay, 5-bromo-2-deoxyuridine (BrdU), ELISA, tetrazolium microplate assay and acid phosphatase assay (e.g., Maghni et al. (1999) *J. Immunol. Method.* 223(2):185-194). Cell proliferation also can be measured using kits available from Invitrogen (Cyquant NF cell proliferation assay kit), Cambrex (Vi-aLight HS (high sensitivity) BioAssay), Promega (CellTiter- Glo Luminescent Cell Viability Assay, Guava Technologies (CellGrowth assay), Stratagene (Quantos cell proliferation assay) (e.g., Assays for Cell Proliferation Studies, *Genetic Eng. Biotechnol. News.* 26(6)). In some examples, the cell proliferation can be normalized to proliferation of cells without the immune checkpoint inhibitor. In exemplary proliferation assays, cells can be added to a well of a 96-well plate in normal growth medium that includes the immune checkpoint inhibitor to be assayed.

The immune checkpoint inhibitor, such as anti-immune checkpoint protein antibodies, for example anti-CTLA4 or anti-PD-1 antibodies, can be labeled so that the binding activity can be assessed and determined. For example, to detect binding, the immune checkpoint inhibitor, such as anti-CTLA4 or anti-PD-1 antibodies, can be labeled with a detectable moiety or tag in order to facilitate detection. The skilled artisan can select an appropriate detectable moiety or tag for assay conditions. For example, some secondary reagents, such as anti-Ig antibodies cannot be used to detect binding of a modified protein that is an antibody in a solution that contains human serum. In addition, an anti-IgG antibody cannot be used to detect binding of a biomolecule that is an antibody.

Any detectable moiety or other moiety known to one of skill in the art that is capable of being detected or identified can be used. The moiety or tag can be linked to the test molecule, such as a therapeutic protein or antibody, directly or indirectly, for example using a linker. Linkage can be at the N- or C-terminus of the therapeutic antibody. Exemplary tags and moieties that can be used, include but are not limited to, any set forth in Table 5.

TABLE 5

Exemplary tags and moieties

| Name | Sequence | # of Residues | Size (Da) | SEQ ID NO |
|---|---|---|---|---|
| c-Myc | EQKLISEEDL | 10 | 1200 | 19 |
| FLAG | DYKDDDDK | 8 | 1012 | 20 |
| His | HHHHHH | 6 | | 31 |
| HA | YPYDVPDYA | 9 | 1102 | 32 |
| VSV-G | YTDIEMNRLGK | 11 | 1339 | 42 |
| HSV | QPELAPEDPED | 11 | 1239 | 43 |
| V5 | GKPIPNPLLGLDST | 14 | 1421 | 44 |
| Poly Arg | RRRRR | 5-6 | 800 | 45 |
| Strep-tag-II | WSHPQFEK | 8 | 1200 | 46 |
| S | KETAAAKFERQHMDS | 15 | 1750 | 47 |
| 3x FLAG | DYKDHDGDYKDHDID YKDDDDK | 22 | 2730 | 48 |
| HAT | KDHLIHNVHKEFHAH AHNK | 19 | 2310 | 49 |
| SBP | MDEKTTGWRGGHVVE GLAGELEQLRARLEH HPQGQREP | 38 | 4306 | 50 |

Any linker known to one of skill in the art that is capable of linking the detectable moiety to the therapeutic antibodies described herein can be used. Exemplary linkers include the glycine rich flexible linkers (-G$_4$S-)$_n$, where n is a positive integer, such as 1 (SEQ ID NO: 37), 2 (SEQ ID NO: 38), 3 (SEQ ID NO: 39), 4 (SEQ ID NO: 40), 5 (SEQ ID NO: 41), or more.

3. Anticancer Activity of Combination Therapy

Human or non-human subjects or animal tumor models can be used to determine the efficacy of the combination treatment, by monitoring the tumor, the general health of the subject and/or course of disease in the subject. Any of a variety of monitoring steps can be included to assess efficacy of the combination therapy provided herein, including, but not limited to, monitoring tumor size, monitoring anti-(tumor antigen) antibody titer, monitoring the presence and/or size of metastases, monitoring the subject's lymph nodes, and monitoring the subject's weight or other health indicators including blood or urine markers.

In addition, immune response following administration of the provided combinations can be assessed. The combinations provided herein activate an immune response by inhibiting immune checkpoint proteins. Activation of an immune response elicits clinical activities that are distinct from clinical responses from cytotoxic therapies traditionally used to treat cancers. For example, clinical responses, such as a decrease in tumor size or delay in tumor growth, to cytotoxic therapies are expected to be observed within the first weeks of treatment. In contrast, subjects administered treatments which activate the immune system to treat a tumor can exhibit a delayed response, following stable or even progressive tumor growth in the initial weeks or months following treatment. Immune checkpoint inhibitors also can effect an anti-tumor response that lasts for an extended period following cessation of treatment. For example, durable responses following inhibition of an immune checkpoint protein can be measured in months or years even after cessation of treatment.

In vivo studies using animal models or human or non-human subjects can be performed to assess the therapeutic activity of polymer-conjugated hyaluronan-degrading enzymes, such as PEGPH20, and immune checkpoint inhibitors, such as anti-immune checkpoint protein antibodies, such as anti-CTLA4 or anti-PD-1 antibodies, as described herein, individually and/or in combination. In particular examples, the combinatorial activity of the polymer-conjugated hyaluronan-degrading enzyme (e.g., PEGPH20), and immune checkpoint inhibitor (e.g., anti-CTLA4 or anti-PD-1) is assessed. As described elsewhere herein, typically the agents are administered separately, whereby the hyaluronan-degrading enzyme (e.g., PEGylated hyaluronan-degrading enzyme, such as a PEGylated soluble hyaluronidase), is administered prior to the immune checkpoint inhibitor.

In some examples, animal cancer models are used to assess the combination treatment of a polymer-conjugated hyaluronan-degrading enzyme, such as PEGPH20, and an immune checkpoint inhibitor, such as an anti-immune checkpoint protein antibody (e.g., an anti-CTLA4 or anti-PD-1 antibody). Such uses of animal models can be used to predict efficacy of the combination treatment in cancer patients, by evaluating the activation of the immune response and/or by measuring inhibition of tumor formation, tumor regression or metastasis following administration of the provided combinations. Such animal models can also be used to assess side effects of the combination therapies antibodies provided herein.

In particular examples, therapeutic efficacy of the combination therapy is assessed for treating tumors that are characterized as having a moderate to high HA content, e.g., HA$^{high}$ (or HA+3) tumors. Methods of determining and grading the HA content of a tumor are described herein in Section H. Human subjects can be selected for treatment and therapeutic efficacy of the combination therapy can be assessed or monitored. In other cases, animal models (e.g., mouse xenograft or allograft models) can be generated that have an HA$^{high}$ tumor. In some examples, the cells that are injected into to mouse to generate the mouse cancer model are engineered to produce high levels of hyaluronan, such that the tumor generated by the cell line is an HA$^{high}$ tumor. Such cell lines can be established by stably introducing one or more exogenous genes encoding one or more hyaluronan synthase enzymes, such as hyaluronan synthase 1 (HAS1; set forth in SEQ ID NO: 51), hyaluronan synthase 2 (HAS2; set forth in SEQ ID NO: 52), or hyaluronan synthase 3 (HAS3; set forth in SEQ ID NO: 2).

a. Tumor Growth and Volume

Human or non-human subjects or animal tumor models can be used to determine the efficacy of the combination treatment, by measuring inhibition of tumor formation, tumor regression or metastasis following administration of the provided combinations. Such effects can include monitoring tumor growth and volume to assess a reduction in growth or volume of a tumor as an indicator of therapeutic efficacy. For example, the hyaluronan-degrading enzyme (e.g., hyaluronidase), such as a polymer-conjugated hyaluronan-degrading enzyme (e.g., PEGylated hyaluronidase, such as PEGPH20) and immune checkpoint inhibitor, such as an anti-immune checkpoint protein antibody, formulations can be administered to a tumor-bearing animal, and body weights and tumor volumes monitored. The timing of pre-administration of the hyaluronan-degrading enzyme can be adjusted to assess the optimal dosage regimen for the combination therapy.

Activity of the combination therapy provided herein can be assessed by monitoring anti-tumorigenicity or tumoricidal activity, such as shrinkage of tumor size and/or delay in tumor progression. Hence, for example, the combination therapies can be assessed to identify those that decrease the rate of tumor growth or reduce tumor size. Tumor size can be assessed in vivo in tumor-bearing human or animal models treated with any of the combinations provided herein. Tumor shrinkage or tumor size can be assessed by various assays known in art, such as, by weight, volume or physical measurement.

Tumor-bearing animal models can be generated. In vivo tumors can be generated by any known method, including syngeneic tumors generated by inoculating (e.g., by subcutaneous injection) a mouse or rat tumor cell line into the corresponding immunocompetent mouse or rat strain, metastatic tumors generated by metastasis of a primary tumor implanted in the animal model, allograft tumors generated by the implantation of tumor cells into same species as the origin of the tumor cells, xenograft tumors by transplanting human cancer cells lines or solid tumors into a mouse that has an impaired immune system (e.g., nude mice) and spontaneous tumors generated by genetic manipulation of the animal. The tumor models can be generated orthotopically by injection of the tumor cells into the tissue or organ of their origin, for example, implantation of breast tumor cells into a mouse mammary fat pad.

Typically, syngeneic or allograft animal models are used. In such models, the animals are immunocompetent. An intact immune system is required to assess the activation of the immune system in response to the combination therapy employing immune checkpoint inhibitors. Syngeneic or allogeneic cells (i.e., cells from the same genetic background) are used to prevent rejection and induction of an immune response associated with a xenograft in an immunocompetent animal. Non-limiting examples of syngeneic tumor mouse models are set forth in the Table 6 below.

TABLE 6

Syngeneic Mouse Tumor Model

| Tumor Type | Cell Line Name | Strain of Mice |
|---|---|---|
| Carcinoma | CT26.CL25 | BALB/c |
| Carcinoma | CT26.WT | BALB/c |
| Carcinoma | MTC-M | BALB/c |
| Cervical carcinoma | U14 | ICR |
| Liver carcinoma | H22 | ICR |
| Lung carcinoma | Lewis | C57BL6 |
| Lung carcinoma | K7M2 | BALB/c |
| Melanoma | B16F1, B16F10, B16BL6 | C57BL6 |
| Myeloma | P3X63Ag8.653 | BALB/c |
| Sarcoma | S180 | ICR |
| Sarcoma | A20 | BALB/c |

In some examples, tumors can be established by intramuscular injection, adjacent to the right tibial periosteum, armpit with a tumor cell suspension (e.g., $2 \times 10^5$ cells/animal) into any tumor animal model, and typically an immunocompetent host (syngeneic). The animal models include models in any organism described herein or known in the art, such as, for example, a mammal, including monkeys and mice. In some examples, the testing of the provided combinations can include study of efficacy in primates (e.g., cynomolgus monkey model) to facilitate assessment of therapeutic efficacy directed against the tumor. Additional primate models include but are not limited to those using the rhesus monkey.

In some examples, the recipient of the tumor can be any suitable murine strain. Examples of animals in which tumor cells can be transplanted include BALB/c mice, C57BL/6 mice. Other examples include transgenic mice (including knockins and knockouts). For example, the combination therapy provided herein can be tested in a mouse cancer model, for example a syngeneic tumor mouse model. In this method, a syngeneic tumor or tumor cell line is grafted onto or injected into a mouse, and subsequently the mouse is treated with a hyaluronan-degrading enzyme (e.g., a hyaluronidase, such as a polymer-conjugated hyaluronan degrading agent, for example a PEGylated soluble hyaluronidase (e.g., PEGPH20), and an immune checkpoint protein blocking/inhibitory agent, such as an antibody (e.g., an anti-CTLA4 or anti-PD-1 antibody) to determine the ability of the combination therapy to reduce or inhibit tumor growth and/or metastasis.

Tumor size and volume can be monitored based on techniques known to one of skill in the art. For example, tumor size and volume can be monitored by radiography, ultrasound imaging, necropsy, by use of calipers, by microCT or by $^{18}$F-FDG-PET. Tumor size also can be assessed visually. In particular examples, tumor size (diameter) is measured directly using calipers. In other examples, tumor volume can be measured using an average of measurements of tumor diameter (D) obtained by caliper or ultrasound assessments. The volume can be determined from the formula $V = D^3 \times \pi/6$ (for diameter measured using calipers); the formula $V = [length \times (width)]/2$ where length is the longest diameter and width is the shortest diameter perpendicular to length; or $V = D^2 \times d \times \pi/6$ (for diameter measured using ultrasound where d is the depth or thickness).

For example, caliper measurements can be made of the tumor length (1) and width (w) and tumor volume calculated as length×width$^2$×0.52.

In another example, tumor volumes are measured by ultrasound. In such an example, the animals can be anesthetized using light isoflurane anesthesia and region of interest coved in ultrasound gel. The scan head is positioned over the region of interest and the center of the tumor is located by ultrasound (e.g., using a VisualSocnics Vevo 2100 ultrasound) in 2D-Mode. An image is then captured in 3D-mode and the tumor volume is analyzed to calculate the volume in mm$^3$ (e.g., using Vevo 2100 v1.5.0 imaging software).

In another example, microCT scans can be used to measure tumor volume (see e.g., Huang et al. (2009) *PNAS*, 106:3426-3430). In such an example, mice can be injected with Optiray Pharmacy ioversol injection 74% contrast medium (e.g., 741 mg of ioversol/mL), mice anesthetized, and CT scanning done using a MicroCat 1A scanner or other similar scanner (e.g., IMTek) (40 kV, 600 µA, 196 rotation steps, total angle or rotation=196). The images can be reconstructed using software (e.g., RVA3 software program; ImTek). Tumor volumes can be determined by using available software (e.g., Amira 3.1 software; Mercury Computer Systems).

Once the implanted tumors reach a predetermined size or volume, the combination therapy can be administered. Progressing tumors can be visualized and tumor size and tumor volume can be measured using any technique known to one of skill in the art. For example, tumor volume or tumor size can be measured using any of the techniques described herein. Tumor volume and size can be assessed or measured at periodic intervals over a period of time following administration of the combination provided herein, such as, for example, at least, or up to, or once every hour, every 6 hours, every 12 hours, every 24 hours, every 36 hours, every 2 days, every 3 days, every 4 days, every 5 days, every 6 days, every 7 days, every 2 weeks, every 3 weeks, every month or more post-infection. A graph of the median change in tumor volume over time can be made. The total area under the curve (AUC) can be calculated. A therapeutic index also can be calculated using the formula $AUC_{control\ animals} - AUC_{treated\ animals}/AUC_{control\ animals} \times 100$. Control animals can be either untreated (vehicle-treated) animals, animals treated with a control therapy, such as an isotype control antibody, or animals treated with the polymer-conjugated hyaluronan-degrading enzyme (e.g., PEGPH20) alone or an immune checkpoint inhibitor (e.g., an anti-immune checkpoint protein antibody) alone.

Tumor grown inhibition (TGI) can be calculated at a chosen time point using the average tumor volume of test animals using the formula: 1-(average tumor volume, test article$_{(last\ day)}$-average tumor volume, test article$_{(baseline\ measurement)}$)/(average tumor volume, control$_{(last\ day)}$-average tumor volume, control$_{(baseline\ measurement)}$)×100%, wherein the test article is the administration of the polymer-conjugated hyaluronan-degrading enzyme, such as PEGPH20, and the immune checkpoint inhibitor, such as an anti-immune checkpoint protein antibody (e.g., an anti-CTLA4 or anti-PD-1 antibody), individually or as a combination therapy, wherein the polymer-conjugated hyaluronan-degrading enzyme (e.g., PEGPH20) and the immune checkpoint inhibitor (e.g., anti-immune checkpoint protein antibody) are administered at the same time, or sequentially, as described herein. In particular examples, the immune checkpoint inhibitor, such as an anti-immune checkpoint protein antibody (e.g., an anti-CTLA4 or anti-PD-1 antibody), is administered after administration of the polymer-conjugated hyaluronan-degrading enzyme, such as PEGPH20. The control tumors are those from either untreated (vehicle-treated) animals, animals treated with a control therapy, such as an isotype control antibody, or animals treated with the polymer-conjugated hyaluronan-degrading enzyme (e.g., PEGPH20) alone or an immune checkpoint inhibitor (e.g., an anti-immune checkpoint protein antibody) alone.

Assessment of the activity of the combination therapies provided herein can include identifying dosages or dosage regimens that mediate a decrease in tumor size (e.g., diameter), volume or weight compared to control treated or untreated tumor-bearing animals. It is understood that a decrease in tumor size, volume or weight compared to control treated or untreated tumor-bearing animals means that the combination therapy is mediating the tumor regression or shrinkage observed or that the combination therapy is mediating delayed tumor progression compared to control treated or untreated tumor-bearing animals. Tumor shrinkage or delay in tumor progression are parameters indicative of anti-tumorigenicity.

Assessment can include identifying a combination therapy that results in animals exhibiting a ratio of tumor shrinkage, calculated as the ratio of the control tumor: the treated tumor, that is greater than 1.0, for example, that is greater than 1.1, 1.2, 1.3, 1.4, 1.5, 1.6, 1.7, 1.8, 1.9, 2, 3, 4, 5, 6, 7, 8, 9, 10, 20, 30, 40, 50 or more. In particular examples, the results are presented as a ratio of the total AUC area during the course of treatment (AUC of tumor size or volume of control animals/AUC tumor size or volume of treated animals). For example, a combination therapy can result in a ratio of tumor shrinkage in a subject as measured by AUC that is greater than 1.1, 1.2, 1.3, 1.4, 1.5, 1.6, 1.7, 1.8, 1.9, 2, 3, 4, 5, 6, 7, 8, 9, 10, 20, 30, 40, 50 or more. It is understood that a ratio of 1.2 or 5 means that the combination therapy effects a decreased tumor size or volume and results in 120% or 500% anti-tumorigenicity activity compared to the reference or control.

In particular examples, the therapeutic index is determined as a measure of effects of a provided combination therapy on tumor size or volume. A combination therapy provided herein can have a therapeutic index that is at least or about at least or 120%, 130%, 140%, 150%, 160%, 170%, 180%, 190%, 200%, 250%, 300%, 400%, 500%, 600%, 700%, 800% or more compared to the therapeutic index of a control.

In additional examples, tumors can be harvested from the animals and weighed. Administration of a combination provided herein can result in a decrease in tumor weight compared to tumors harvested from control tumor-bearing animals. The weight also can be compared to tumors harvested from control treated animals at the same time post-administration. The change in weight can be presented as a ratio of the tumor weight (tumor weight control animals/tumor weights of treated animals). A combination therapy provided herein can result in subjects exhibiting a ratio of control:treated tumor weight that is greater than 1.0, for example, that is greater than 1.1, 1.2, 1.3, 1.4, 1.5, 1.6, 1.7, 1.8, 1.9, 2, 3, 4, 5, 6, 7, 8, 9, 10, 20, 30, 40, 50 or more. It is understood that a ratio of tumor weight that is 1.2 or 5 means that the combination therapy effects a decreased tumor weight and results in 120% or 500% anti-tumorigenicity activity compared to the reference or control.

The efficacy of the combination therapy also can be evaluated according to guidelines that provide an objective response criteria for evaluating anti-tumor therapeutics. Such guidelines are known to a skilled artisan. For example, published guidelines include those published by the World Health Organization (WHO) (see World Health Organization, "WHO Handbook for Reporting Results of Cancer Treatment," (1979) WHO Offset Publication No. 48, Geneva pp. 1-45 and Miller et al., (1981) *Cancer.* 47:207-214), and those published as Response Evaluation Criteria in Solid Tumors (RECIST) (Eisenhauer et al., (2009) *Eur J Cancer.* 45(2):228-247). These guidelines are provided to define when tumors in cancer patients improve ("respond"), stay the same ("stabilize"), or worsen ("progress") during treatments. These criteria apply only to the tumor phenotypes and are not a measure of whether a patient has improved. A treating physician evaluates the treatment of the disease using a combination of the objective measurements described in guidelines and with patient symptomatic criteria.

For example, according to non-limiting guidelines for assessing therapeutic efficacy on tumors, evaluation of the tumor response can involve selecting for measurement up to 5 tumors per organ and up to 10 tumors in total, that are representative of all affected organs. The tumors can be selected based on their size (i.e., those with the longest diameter) and their suitability for accurate repeated measurements using imaging or clinical techniques. For WHO, the sum of the products of the two largest perpendicular diameters (SPD), and for RECIST, a sum of the longest diameter (LD) for each of the tumors, can be calculated and can be reported as the baseline SPD or baseline sum LD, respectively. The baseline SPD, or baseline sum LD, is the reference to which the tumor response is compared for evaluation. The presence of other tumors, not selected for measurement, i.e., "non-target" tumors, also are noted under RECIST guidelines.

The tumors can be measured by any reproducible method. For example, CT (computed tomography) or MRI (magnetic resonance imaging) with cuts of 10 mm or less in slice thickness, or spiral CT using a 5 mm continuous reconstruction algorithm, can be used to measure tumor size. In some examples, the tumors can be measured by chest X-ray or ultrasound. It can also be possible to measure tumors using endoscopy or laparoscopy.

At the completion and/or at pre-determined intermediate time points of a clinical study, the SPD or sum LD can be calculated and the response can be evaluated as follows. A Complete Response (CR) is defined as disappearance of all measured tumors. For WHO, the disappearance must be observed in two consecutive observations not less than 4 weeks apart. The tumors are categorized as exhibiting a Partial Response (PR) when there is at least a 50% decrease in the SPD (WHO) or 30% decrease in the sum of the LD (RECIST), using the baseline PSD or baseline sum LD as the reference, respectively. For WHO, the tumor is categorized as a Progressive Disease (PD) when there is at least a 25% increase in SPD compared with the smallest SPD since the start of treatment (i.e., nadir) and/or progression of non-target tumors and/or appearance of new tumors at any time point. For RECIST, the tumor is categorized as a Progressive Disease (PD) when there is at least a 20% increase in the sum of LD, taking as reference the smallest sum LD recorded since the start of treatment (i.e., nadir) or the appearance of new tumors. The tumor is considered to be a Stable Disease (SD) when tumor shrinkage is less than 50%, but tumor growth does not exceed 25% compared with nadir, as long as there are no new tumors and the non-target tumors do not increase in size. Similarly, according to RECIST guidelines, the cancer is considered to be an SD when tumor shrinkage is less than 30%, but does not exhibit more than a 20% increase in the sum of LD, with no new tumors and no increase in size of non-target tumors.

The WHO and RECIST guidelines were developed to monitor responses and to evaluate cytotoxic tumor therapies. As described above, immunotherapy treatments exhibit some responses that are distinct from those of cytotoxic treatments. For example, an early increase in tumor burden and/or the appearance of new tumors signal progressive disease (PD), according to RECIST guidelines, and is considered to be an indication of drug failure. According to protocols relying on such guidelines, cessation of treatment is often recommended once a tumor has been characterized as PD. In the case, of immunotherapies, however, an initial increase in tumor size can be indicative of infiltration of immune cells or a transient inflammatory response, that indicates efficacy rather than drug failure. Thus, a set of guidelines, specific to immunotherapies has been developed, called immune-related response criteria (irRC) (Wolchok et al., (2009) *Clin Cancer Res.* 15(23):7412-7420 and Nishino et al., (2013) *Clin Cancer Res.* 19(14):3936-3943). Thus, in examples herein, therapeutic efficacy can be evaluated according to irRC guidelines, or other similar guidelines known to a skilled artisan. A comparison of the guidelines is set forth in Table 7 below.

TABLE 7

| | Comparison of guidelines for evaluating solid tumors | | | |
| --- | --- | --- | --- | --- |
| | Bidimensional assessment | | Unidimensional assessment | |
| | WHO | irRC | RECIST | irRC |
| Measurable lesions | ≥5 × 5 mm² by bidimensional measurements | ≥5 × 5 mm² by bidimensional measurements | ≥10 mm in the longest diameter | ≥10 mm in the longest diameter |
| Measurement of each lesion | The longest diameter × the longest perpendicular diameter (cm²) | The longest diameter × the longest perpendicular diameter (cm²) | The longest diameter (cm) | The longest diameter (cm) |
| Tumor burden (sum of the measurements) | The sum of the bidimensional measurements target lesions (only) | The sum of the bidimensional measurements of all target lesions and new lesions if any | The sum of the longest diameters target lesions only | The sum of the longest diameters of all target lesions and new lesions if any |

TABLE 7-continued

Comparison of guidelines for evaluating solid tumors

| | Bidimensional assessment | | Unidimensional assessment | |
| --- | --- | --- | --- | --- |
| | WHO | irRC | RECIST | irRC |
| New, measurable lesions | Always represent PD | Do not define progression; Incorporated into tumor burden | Always represent PD | The presence of new lesion(s) does not define progression. The measurements of the new lesion(s) are included in the sum of the measurements. |
| New, nonmeasurable Non-index lesions | Always represent PD Changes contribute to defining CR, PR, SD, and PD | Do not define progression Contribute to defining irCR (complete disappearance required) | Always represent PD Changes contribute to defining CR, PR, SD, and PD | Do not define progression Contribute to defining irCR (complete disappearance required) |
| CR | Disappearance of all lesions* | Disappearance of all lesions* | Disappearance of all lesions* | Disappearance of all lesions* |
| PR | ≥50% decrease in SPD of all index lesions compared with baseline* | ≥50% decrease in tumor burden compared with baseline* | ≥30% decrease from baseline* | ≥30% decrease from baseline* |
| SD | <50% decrease in tumor burden compared with baseline and <25% increase from with nadir, no new lesions and no progression of non-target lesions | <50% decrease in tumor burden compared with baseline and <25% increase from with nadir | <30% decrease in tumor burden compared with baseline and <20% increase from the nadir, no new lesions and no progression of non-target lesions | <30% decrease in tumor burden compared with baseline and <20% increase from the nadir |
| PD | ≥25% from the nadir*, and/or any increase in size of non-target lesions and/or any new lesions (at any single time point) | ≥25% increase from the nadir* | ≥20% increase from the nadir*, and/or any increase in size of non-target lesions and/or any new lesions (at any single time point) | ≥20% increase from the nadir* |

*confirmation by 2 consecutive observation no less than 4 weeks apart required

Any or all of the WHO, RECIST and irRC guidelines, or other guidelines known to a skilled artisan and indicative of a response to treatment of a tumor, can be used to evaluate efficacy of the combination treatments, methods and uses provided herein. Exemplary methods of assessing the anti-tumor activities of the combinations provided herein are described below in Section G3.

b. Presence of Tumor Markers

The presence and extent of tumor markers, in the blood, urine or body tissues, also can be measured and used for response evaluation. Such markers are known to a skilled artisan to correlate with response to tumor treatment. The presence of the marker can be compared to a control subject or population of subjects that does not have a tumor or baseline sample from a subject prior to treatment or prior to the last dose or interval of therapy. Expression of the marker at levels higher than a control or normal sample correlates to the existence of a tumor. A decrease in the level or extent of the marker relative to a baseline sample can indicate response to treatment. In some examples, for example, when the marker is an intracellular marker, an increase in the marker in the peripheral blood is indicative of tumor cell lysis and therapeutic efficacy of the immunotherapy. A database containing T cell-defined tumor associated antigen peptide sequences has been created (Vigneron et al., (2013) Cancer Immun. 13:15; see e.g., also databases, such cancer.gov/about-cancer/diagnosis-staging/diagnosis/tumor-markers-fact-sheet). Exemplary tumor markers and their associated tumor types are set forth in Table 8 below:

TABLE 8

Exemplary tumor markers and associated tumor types

| Tumor marker | Associated tumor type(s) |
| --- | --- |
| Alpha fetoprotein (AFP) | germ cell tumor, hepatocellular carcinoma |
| CA15-3 | breast cancer |
| CA27-29 | breast cancer |
| CA19-9 | pancreatic cancer, also colorectal cancer and other types of gastrointestinal cancer. |

TABLE 8-continued

Exemplary tumor markers and associated tumor types

| Tumor marker | Associated tumor type(s) |
| --- | --- |
| CA-125 | Ovarian cancer, also endometrial cancer, fallopian tube cancer, lung cancer, breast cancer and gastrointestinal cancer. |
| Calcitonin | medullary thyroid carcinoma |
| Calretinin | mesothelioma, sex cord-gonadal stromal tumour, adrenocortical carcinoma, synovial sarcoma |
| Carcinoembryonic antigen (CEA) | gastrointestinal cancer, cervix cancer, lung cancer, ovarian cancer, breast cancer, urinary tract cancer |
| CD34 | hemangiopericytoma/solitary fibrous tumor, pleomorphic lipoma, gastrointestinal stromal tumor, dermatofibrosarcoma protuberans |
| CD99 | Ewing sarcoma, primitive neuroectodermal tumor, hemangiopericytoma/solitary fibrous tumor, synovial sarcoma, lymphoma, leukemia, sex cord-gonadal stromal tumour |
| CD117 | gastrointestinal stromal tumor, mastocytosis, seminoma |
| Chromogranin | neuroendocrine tumor |
| Chromosomes 3, 7, 17, and 9p21 | bladder |
| Cytokeratin (various types) | Many types of carcinoma, some types of sarcoma |
| Desmin | smooth muscle sarcoma, skeletal muscle sarcoma, endometrial stromal sarcoma |
| Epithelial membrane antigen (EMA) | many types of carcinoma, meningioma, some types of sarcoma |
| Epithelial tumor antigen (ETA) | breast cancer |
| Factor VIII, CD31 FL1 | vascular sarcoma |
| Glial fibrillary acidic protein (GFAP) | glioma (astrocytoma, ependymoma) |
| Gross cystic disease fluid protein (GCDFP-15) | breast cancer, ovarian cancer, salivary gland cancer |
| HMB-45 | melanoma, PEComa (for example angiomyolipoma), clear cell carcinoma, adrenocortical carcinoma |
| Human chorionic gonadotropin (hCG) | gestational trophoblastic disease, germ cell tumor, choriocarcinoma |
| Immunoglobulin | lymphoma, leukemia |
| Inhibin | sex cord-gonadal stromal tumour, adrenocortical carcinoma, hemangioblastoma |
| Keratin (various types) | carcinoma, some types of sarcoma |
| Lymphocyte marker (various types | lymphoma, leukemia |
| MART-1 (Melan-A) | melanoma, steroid-producing tumors (adrenocortical carcinoma, gonadal tumor |
| Melanoma-associated antigen (MAGE) | malignant melanoma |
| MUC-1 | breast cancer |
| Muscle-specific actin (MSA) | myosarcoma (leiomyosarcoma, rhabdomyosarcoma) |
| Myo D1 | rhabdomyosarcoma, small, round, blue cell tumour |
| Neurofilament | neuroendocrine tumor, small-cell carcinoma of the lung |
| Neuron-specific enolase (NSE) | neuroendocrine tumor, small-cell carcinoma of the lung, breast cancer |
| NY-ESO-1 | melanoma, ovarian cancer, breast cancer, bladder cancer prostate cancer hepatocellular carcinoma |
| Placental alkaline phosphatase (PLAP) | seminoma, dysgerminoma, embryonal carcinoma |
| Prostate-specific antigen | prostate |
| PTPRC (CD45) | lymphoma, leukemia, histiocytic tumor |
| S100 protein | melanoma, sarcoma (neurosarcoma, lipoma, chondrosarcoma), astrocytoma, gastrointestinal stromal tumor, salivary gland cancer, some types of adenocarcinoma, histiocytic tumor (dendritic cell, macrophage) |
| Smooth muscle actin (SMA) | gastrointestinal stromal tumor, leiomyosarcoma, PEComa |
| Synaptophysin | neuroendocrine tumor |
| Thyroglobulin | post-operative marker of thyroid cancer (but not in medullary thyroid cancer) |
| Thyroid transcription factor-1 | all types of thyroid cancer, lung cancer |
| Tumor M2-PK | colorectal cancer, Breast cancer renal cell carcinoma Lung cancer, Pancreatic cancer, Esophageal Cancer, Stomach Cancer, Cervical Cancer, Ovarian Cancer |
| Tyrosinase | malignant melanoma |
| Vimentin | sarcoma, renal cell carcinoma, endometrial cancer, lung carcinoma, lymphoma, leukemia, melanoma |

In some cases, according to various guidelines for assessing therapeutic efficacy, such as those discussed above, the marker levels in combination with the sizes of non-target tumors also are taken into account among the response criteria, with CR referring to the disappearance of all non-target tumors and normal levels of tumor maker, incomplete response or SD referring to the persistence of one or more non-target tumors and/or tumor marker levels above normal limits, and PD referring to the appearance of one or more new tumors and/or progression of existing non-target tumors.

c. Immunological Monitoring

The combination therapy provided herein acts to inhibit immune checkpoint protein activity and thereby reduce inhibition of an immune response or enhance an immune response so that the subject receiving the combination therapy provided herein can develop anti-tumor immunity. Several criteria can be used to evaluate immune therapy in solid tumors to assess an immune response in a subject, such as in patient or animal models, that correlate with clinical efficacy of a cancer treatment (see, e.g., Clay et al., (2001) *Clin Cancer Res.* 7:1127-1135, incorporated herein by reference). Immunological monitoring can include, but is not limited to, monitoring the frequency of specific cell types, such as specific immune cells, in peripheral blood or in tumors, monitoring changes in expression levels of specific markers on immune cells, quantifying antigen-specific immune responses including antibody and CD4+ or CD8+ T cell responses, and monitoring changes in peripheral levels of cytokines produced by specific immune cell populations.

i. Frequency of Specific Cell Types in Peripheral Blood

Counts of specific immune cell types in peripheral blood or tissues, such as tissues associated with an immune response (e.g., spleen or lymph nodes) or tumors, can be used to correlate cancer treatments with clinical efficacy. The frequency of specific cell types in the blood of treated patients or animals can be determined, for example, using flow cytometric methods. When using flow cytometry to derive cell type counts, a dual platform approach or a single platform approach can be employed.

In a dual platform approach, a flow cytometer is used to determine the cells of interest as a percentage of a reference population, such as the CD4+ T lymphocyte cells as a percentage of the total lymphocyte population. The absolute white blood cell count (WBC) and the lymphocyte percentage are then determined using a hematology analyzer, using standard procedures. The absolute CD4+ T lymphocyte count, thus, is the product of the absolute WBC, the lymphocyte percentage and the CD4+ T lymphocyte percentage. The cell population of interest can be identified, for example, using light scatter limitations, such as forward scatter and side-scatter limitations, to identify the cells of interest based on morphology. In particular methods, blood samples can be incubated with antibodies that recognize one or more immunological markers and unidimensional or multidimensional gating strategies can be used to identify the population of interest. These methods are routine to those of skill in the art. Non-limiting exemplary markers, which can be used distinguish particular populations of lymphocytes, are set forth in Table 9.

TABLE 9

| Recognition markers for lymphocytes | |
| --- | --- |
| Cell Type | Phenotypic Marker(s) |
| NK cells | CD16 CD56 but not CD3 |
| Helper T cells | TCRαβ, CD3 and CD4 |
| Cytotoxic T cells | TCRαβ, CD3, CD8, CD107, IFN☐ |
| γδ T cells | TCRγδ and CD3 |
| B cells | MHC class II, CD19 and CD21 |

In a single platform approach, the cell count is derived from the flow cytometer itself, without the need for a hematology analyzer. For this method, a precise, known volume of sample is mixed with relevant antibodies directed to the immunological marker(s) to be detected, and a gating strategy is employed to accurately identify the cell population of interest. The cell population can then be related back to the volume by a variety of methods known to the skilled artisan. These include microbead, volumetric, microfluorometric, and flow rate calibration methods.

The most common method of determining the concentration of the cell population of interest is through the use of microbeads. For example, a sample and microbeads (with a diameter of 5-10 μm), suspended in a known concentration, are mixed in equal volumes. The number of cell events and the number of bead events are counted, and the absolute cell concentration is determined using the formula:

Absolute Cell Count=Number cell events/Number bead events×bead concentration.

In some examples of immunological monitoring, the absolute lymphocyte count (ALC) is determined, for example in samples collected from blood, spleen or tumor draining lymph node tissues, or tumor biopsies prior to treatment and at one or more predetermined times after administration of the provided therapy. The absolute lymphocyte count is the number of lymphocytes in peripheral blood per unit volume. The ALC can be determined prior to or on the same day as administration of the combination therapy provided herein and periodically at various times after administration, such as after the previous administration or last administration of a cycle of administration, for example at least or up to or every 1 day, 2 days, 3 days, 4 days, 5 days, 6 days, 7 days, 2 weeks, 3 weeks, 4 weeks, 5 weeks, 6 weeks, 7 weeks, 8 weeks or 12 weeks after administration, such as after the previous administration or last administration of a cycle of administration, of the combination therapy provided herein, such as 1 day, 2 days, 3 days, 4 days, 5 days, 6 days, or 7 days after administration. An increase in ALC over time prior to and during immunotherapeutic treatment, indicates an increase in the proliferation of immune cells and has been positively correlated with clinical benefit (Berman et al., (2009) *J Clin Oncol* 27:15s, (suppl; abstr 3020)). In some examples the ALC at 1 day, 2 days, 3 days, 4 days, 5 days, 6 days, 7 days, 2 weeks, 3 weeks, 4 weeks, 5 weeks, 6 weeks, 7 weeks, 8 weeks or 12 weeks after administration, such as after the previous administration or last administration in a cycle of administration, is increased 1.1-fold, 1.2, 1.3, 1.4, 1.5, 1.6, 1.7, 1.8, 1.9, 2, 3, 4, 5, 6, 7, 8, 9, 10, 20, 30, 40, 50, or more, fold compared to the ALC at prior to or on the same day as administration and is correlated with a therapeutic effect.

In other examples, absolute counts of natural killer (NK) cells (expressing CD16 and CD56 but not CD3 markers), Helper T cells (expressing TCRαβ, CD3 and CD4 markers), cytotoxic T cells (or effector T cells; expressing TCRαβ, CD3 and CD8 markers or CD8, CD107 and IFNγ markers), or B cells (expressing MHC class II, CD19 and CD21 markers), can be determined as a method of measuring immunological activity in response to administration of the combination therapy provided herein, where an increase in one or more of these lymphocyte populations indicates an increase in immune activity. The counts of natural killer (NK) cells, Helper T cells, cytotoxic T cells (or effector T cells), and/or B cells, can be determined prior to or on the same day as administration of the immunomodulatory combination therapy provided herein and at 1 day, 2 days, 3 days, 4 days, 5 days, 6 days, 7 days, 2 weeks, 3 weeks, 4 weeks, 5 weeks, 6 weeks, 7 weeks, 8 weeks or 12 weeks after administration, such as after the previous administration or last administration of a cycle of administration, of the combination therapy provided herein, such as 1 day, 2 days, 3 days, 4 days, 5 days, 6 days, or 7 days after administration. An increase in the counts of natural killer (NK) cells, helper T cells, cytotoxic T cells (or effector T cells), and/or B cells over time prior to and during immunotherapeutic treatment, indicates an increase in the proliferation of immune cells and may be positively correlated with clinical benefit. In some examples, the counts of natural killer (NK) cells, helper T cells, cytotoxic T cells (or effector T cells), and/or B cells at 1 day, 2 days, 3 days, 4 days, 5 days, 6 days, 7 days, 2 weeks, 3 weeks, 4 weeks, 5 weeks, 6 weeks, 7 weeks, 8 weeks or 12 weeks after administration, such as after the previous administration or last administration of a cycle of administration, is increased 1.1-fold, 1.2, 1.3, 1.4, 1.5, 1.6, 1.7, 1.8, 1.9, 2, 3, 4, 5, 6, 7, 8, 9, 10, 20, 30, 40, 50, or more, fold compared to the counts of natural killer (NK) cells, helper T cells, cytotoxic T cells (or effector T cells), and/or B cells at prior to or on the same day as administration and is correlated with a therapeutic effect.

Assessing relative numbers of suppressive cell types, such as $T_{reg}$ cells also can be measured by flow cytometry, for example by gating for CD25, Foxp2 and CD4 positivity. Samples for determining counts of $T_{reg}$ cells can be taken, for example, from the spleen, lymph nodes, such as tumor draining lymph nodes, or blood. An increase in the number to $T_{reg}$ cells has been correlated with poor clinical outcome (see Callahan et al., (2010) *Semin Oncol.* 37(5):473-484). Counts of suppressive immune cell types, such as $T_{reg}$ cells, can be measured before and at different time points after administration of the combination therapy provided herein. For example, counts of suppressive immune cell types, such as $T_{reg}$ cells, can be determined on the same day as administration of the immunomodulatory combination therapy provided herein and at 1 day, 2 days, 3 days, 4 days, 5 days, 6 days, 7 days, 2 weeks, 3 weeks, 4 weeks, 5 weeks, 6 weeks, 7 weeks, 8 weeks or 12 weeks after administration, such as after the previous administration or last administration of a cycle of administration, of the combination therapy provided herein, such as 1 day, 2 days, 3 days, 4 days, 5 days, 6 days, or 7 days after administration. In some examples, a maximum therapeutic dose of the provided combination therapy can be determined as the maximum dose that does not induce an increase in the number of suppressive immune cell types, such as $T_{reg}$ cells, in a patient or animal model at 1 day, 2 days, 3 days, 4 days, 5 days, 6 days, or 7 days after administration, such as after the previous administration or last administration of a cycle of administration, compared to the level of $T_{reg}$ cells prior to administration, wherein an increase in the number of suppressive immune cell types, such as $T_{reg}$ cells, is determined to be a 1.1-fold, 1.2, 1.3, 1.4, 1.5, 1.6, 1.7, 1.8, 1.9, 2, 3, 4, 5, 6, 7, 8, 9, 10, 20, 30, 40, 50, or more, fold increase in the number of suppressive immune cell types, such as $T_{reg}$ cells, at the measured time point compared to the number of such cells prior to or on the same day as administration of the combination therapy provided herein.

In some examples, administration of the provided combination therapy, can effect a change in the absolute amount of the effector and/or suppressor cell number, and/or the ratio between these subsets. In some examples an increase in the anti-tumor effect correlates with an increase in the ratio of effector cells to the number of suppressor cells, wherein the ratio of effector cells to suppressor cells at the measured time point is 1.1-fold, 1.2, 1.3, 1.4, 1.5, 1.6, 1.7, 1.8, 1.9, 2, 3, 4, 5, 6, 7, 8, 9, 10, 20, 30, 40, 50, or more greater than the ratio prior to or on the same day as administration of the provided combination therapy.

ii. Detecting Immune Cell Markers

In some examples, detection of particular markers on immune cells can be used to correlate cancer treatments with therapeutic efficacy. Such markers include, but are not limited to inducible costimulator (ICOS), HLA-DR (human MHC II) and CD45RO.

In some examples, ICOS is detected on the surface of T cells to monitor the therapeutic efficacy of the combination therapy provided herein. The ICOS is a member of the Ig gene family and is expressed on CD4+ and CD8+ T cells following activation. An increase in the frequency of CD4+ cells expressing high levels of ICOS correlates with activation of the immune system and therapeutic efficacy.

HDLA-DR is expressed on T cells and is upregulated at late time points after activation, and CD45RO is an established marker for memory T cells. Increases in the numbers of immune cells expressing HDLA-DR and/or CD45RO also can be used to monitor the efficacy of the combination therapies provided herein.

Samples for detection of immune cell markers can be collected from peripheral blood or tissues, such as tissues associated with an immune response (e.g., spleen or lymph nodes) prior to administration of a combination therapy provided herein or on the same day as administration and/or at 1 day, 2 days, 3 days, 4 days, 5 days, 6 days, 7 days, 2 weeks, 3 weeks, 4 weeks, 5 weeks, 6 weeks, 7 weeks, 8 weeks or 12 weeks after administration, such as after the previous administration or last administration of a cycle of administration, of the combination therapy provided herein, such as 1 day, 2 days, 3 days, 4 days, 5 days, 6 days, or 7 days after administration. The markers can be determined, for example, using flow cytometric methods, immunofluorescence and/or Western blot. Such methods are well-known in the art and described herein.

iii. Antigen-Specific Immune Responses

In some examples, antigen-specific immune responses can be used to evaluate the therapeutic efficacy of the combination therapy, methods and uses provided herein. When an immune response is mounted in a tumor-bearing subject, the subject will typically exhibit increased levels of immune cells that recognize tumor-specific, or tumor-associated antigens (TAAs), such as tumor antigen-specific T cells. Thus, an increase in the number of tumor-specific T cells, e.g., cytotoxic T lymphocytes (CTLs) or CD4+ T cells, that specifically bind one or more tumor associated antigens, such as TAAs in the context of major histocompatibility complexes (MEW) (e.g., MEW class I or class II complexes), for example, following an immunotherapeutic treatment, is indicative of an increased anti-tumor response as a result of the treatment. Thus, binding assays using tumor-associated antigen(s) and collected circulating or tumor-localized immune cells can be used to determine if the host has developed an increased response to the tumor-associated antigen(s) in response to an immunotherapy. For example, Tumor-associated antigens for specific cancer types are known to the skilled artisan or can be empirically determined. Non-limiting, exemplary tumor antigens, and their associated cancers, are listed in Table 8 above, in section G3.b.

Promotion of the immune response by administering a combination therapy provided herein can produce, or enhance, an immune response directed to one or more tumor associated antigen(s), as indicated by an increase in the number of immune cells in circulation or in the tumor which specifically bind to the tumor-associated antigen(s). Thus, detection of, or an increase in, an tumor antigen-specific immune response following administration of a combination therapy provided herein is indicative of therapeutic efficacy.

A tumor antigen-specific immune response can be measured, for example, ex vivo, using an MEW tetramer assay, enzyme-linked immunospot (ELISPOT) assay, T cell stimulation assay and/or ELISA. Such methods are well-known to the skilled artisan (see e.g., James et al., (2009) *J Vis Exp.* (25): 1167, Lycke et al., (2001) *Curr Protoc Immunol.* Chapter 7:Unit 7.14; Kruisbeek et al., (2004) *Curr Protoc Immunol.* Chapter 3:Unit 3.12, and herein). Peripheral blood samples, from tumor-bearing patients or animal models, are collected prior to or on the same day as administration of a combination therapy provided herein and at any one or more pre-determined time point(s) following administration of the provided therapy, such as at 1 day, 2 days, 3 days, 4 days, 5 days, 6 days, 7 days, 2 weeks, 3 weeks, 4 weeks, 5 weeks, 6 weeks, 7 weeks, 8 weeks or 12 weeks after administration, such as after the previous administration or last administration of a cycle of administration, of the combination therapy provided herein, such as 1 day, 2 days, 3 days, 4 days, 5 days, 6 days, or 7 days after administration. The blood samples are then fractionated and analyzed using one or more of an MHC tetramer assay, enzyme-linked immunospot (ELISPOT) assay, T cell stimulation assay and/or ELISA to evaluate the induction of an immune response. An antigen-specific immune response is considered to be effected when the measured response post-treatment is increased 1.1-fold, 1.2, 1.3, 1.4, 1.5, 1.6, 1.7, 1.8, 1.9, 2, 3, 4, 5, 6, 7, 8, 9, 10, 20, 30, 40, 50, or more, compared to the baseline sample, measured response prior to treatment or on the day of treatment. Induction of tumor antigen-specific immune response following administration of the provided combination therapy is indicative of therapeutic efficacy.

4. Pharmacokinetics and Pharmacodynamics Assays

Pharmacokinetic and tolerability studies can be performed using animal models or can be performed during clinical studies with patients to assess the effect of the combinations and compositions provided herein. Animal models include, but are not limited to, mice, rats, rabbits, dogs, guinea pigs and non-human primate models, such as cynomolgus monkeys or rhesus macaques. In some instances, pharmacokinetic and tolerability studies are performed using healthy animals. In other examples, the studies are performed using animal models of a disease for which therapy with a combination or composition herein is considered, such as animal models of cancer.

The pharmacokinetic properties of the combinations or compositions provided herein can be assessed by measuring such parameters as the maximum (peak) immunotherapeutic agent (or hyaluronan-degrading enzyme) concentration ($C_{max}$), the peak time (i.e., when maximum immunotherapeutic agent concentration occurs; $T_{max}$), the minimum immunotherapeutic agent, or hyaluronan-degrading enzyme, concentration (i.e., the minimum concentration between doses of immunotherapeutic agent; $C_{min}$), the elimination half-life ($T_{1/2}$) and area under the curve (i.e., the area under the curve generated by plotting time versus concentration; AUC), following administration. Typically, the compositions containing the active agents of the combination therapy provided herein are administered systemically, such as typically intravenously. In instances where the immunotherapeutic agent, or hyaluronan-degrading enzyme, is administered subcutaneously, the absolute bioavailability of the agent or enzyme is determined by comparing the area under the curve of immunotherapeutic agent, or hyaluronan-degrading enzyme, following subcutaneous delivery ($AUC_{sc}$) with the AUC of immunotherapeutic agent, or hyaluronan-degrading enzyme, following intravenous delivery ($AUC_{iv}$). Absolute bioavailability (F), can be calculated using the formula: $F=([AUC]_{sc} \times dose_{sc})([AUC]_{iv} \times dose_{iv})$. The concentration of immunotherapeutic agent, or hyaluronan-degrading enzyme, in the plasma following subcutaneous administration can be measured using any method known in the art suitable for assessing concentrations of an immunotherapeutic agent, or hyaluronan-degrading enzyme, in samples of blood.

A range of doses and different dosing frequency of dosing can be administered in the pharmacokinetic studies to assess the effect of increasing or decreasing concentrations of a co-administered therapy (e.g., immunotherapeutic agent and a hyaluronan-degrading enzyme). Pharmacokinetic properties of administered therapeutics, such as bioavailability, also can be assessed with or without co-administration of the other agent, i.e., polymer-conjugated hyaluronan-degrading enzyme and/or immune checkpoint inhibitor. For example, dogs, such as beagles, can be administered an immune checkpoint inhibitor in combination with polymer-conjugated hyaluronan-degrading enzyme, such as after administration of the polymer-conjugated hyaluronan-degrading enzyme, or an immune checkpoint inhibitor or polymer-conjugated hyaluronan-degrading enzyme can be administered alone, using one or more routes of administration. Such studies can be performed to assess the effect of co-administration with an anti-hyaluronan agent, such as a hyaluronidase, on pharmacokinetic properties, such as bioavailability, of the immune checkpoint inhibitor.

Studies to assess safety and tolerability also are known in the art and can be used herein. Following administration of the combination and compositions herein, the development of any adverse reactions can be monitored. Adverse reactions can include, but are not limited to, injection site reactions, such as edema or swelling, headache, fever, fatigue, chills, flushing, dizziness, urticaria, wheezing or chest tightness, nausea, vomiting, rigors, back pain, chest pain, muscle cramps, seizures or convulsions, changes in blood pressure and anaphylactic or severe hypersensitivity responses.

The development of immune-related adverse events (irAEs) also can be monitored. irAEs include rashes, but can in rare cases progress to life-threatening toxic epidermal necrolysis, and colitis, characterized by a mild to moderate, but occasionally also severe and persistent diarrhea. In some examples, Hypophysitis, hepatitis, pancreatitis, iridocyclitis, lymphadenopathy, neuropathies also can occur in response to immunotherapy. Side effects also can include musculoskeletal sides effects (see U.S. Publ. No. 2012/0020951). Typically, a range of doses and different dosing frequencies can be administered in the safety and tolerability studies to assess the effect of increasing or decreasing concentrations of immune checkpoint inhibitor, such as an anti-immune checkpoint protein antibody (e.g., an anti-CTLA4 or anti- PD-1 antibody) and/or anti-hyaluronan agent, such as a polymer-conjugated hyaluronan-degrading enzyme, on any observed side effects.

G. Methods and Uses of Combination Therapy

The combinations and compositions provided herein can be used in methods of therapy for treating cancers, and in particular cancers characterized by solid tumors that have a phenotype of at least moderate to high HA. In the methods, a combination therapy of a polymer-conjugated hyaluronan-degrading enzyme, such as a hyaluronidase, such as a PH20, for example PEGPH20 and an immune checkpoint inhibitor, such as an anti-immune checkpoint protein antibody (e.g., an anti-CTLA4 or anti-PD-1 antibody) is administered to a subject having a solid tumor that is characterized as having at least a moderate to high levels of HA. In some examples, a further antineoplastic agent or therapy, such as a chemotherapeutic agent, radiotherapy, or surgery can included in the combination therapies provided herein.

As found herein, the anti-tumor effects of an immune checkpoint inhibitor agent, such as an anti-immune checkpoint protein antibody (e.g., anti-CTLA4 or anti-PD-1), when administered in a combination regimen with a polymer-conjugated hyaluronan-degrading enzyme, far exceeds the effects when the anti-immune checkpoint protein antibody is administered alone. In particular, such results occur when the polymer-conjugated hyaluronan-degrading enzyme (e.g., polymer-conjugated soluble hyaluronidase, such as PEGPH20) is administered prior to administering the immune checkpoint inhibitor, and generally up to 48 hours (e.g., 24 hours) prior. For example, the effects can be synergistic or they can be additive. The anti-tumor activity observed in the combination therapy provided herein achieves results that have heretofore not been achieved with existing immunotherapies.

1. Cancers

The combination therapy of an anti-hyaluronan agent, e.g., polymer-conjugated hyaluronan-degrading enzyme, and an agent that increases the immune response by blocking an immune checkpoint protein (i.e., immune checkpoint inhibitor), such as an anti-immune checkpoint protein antibody (e.g., an anti-CTLA4 or anti-PD-1 antibody), can be used for the treatment of cancerous cells, neoplasms, tumors and metastases. The combination therapy provided herein activates the host's immune response, thereby exhibiting antitumor efficacy which results in a slowing or reduction of tumor growth, a decrease in tumor volume, and in some cases elimination or eradication of the tumor. For cancers that are characterized by having a high HA content, such as pancreatic cancer, the combination therapy provides significant benefits compared to administration of an anti-immune checkpoint protein alone.

For example, the combination therapy can be used to treat any tumor, characterized as having a moderate to high HA content, such as tumors of the lung and bronchus, breast, colon and rectum, kidney, stomach, esophagus, liver and intrahepatic bile duct, urinary bladder, brain and other nervous system, head and neck, oral cavity and pharynx, cervix, uterine corpus, thyroid, ovary, testes, prostate, malignant melanoma, cholangiocarcinoma, thymoma, non-melanoma skin cancers, as well as hematologic tumors and/or malignancies, such as childhood leukemia and lymphomas, multiple myeloma, Hodgkin's disease, lymphomas of lymphocytic and cutaneous origin, acute and chronic leukemia such as acute lymphoblastic, acute myelocytic or chronic myelocytic leukemia, plasma cell neoplasm, lymphoid neoplasm and cancers associated with AIDS, wherein the tumor has a moderate to high HA content. Typically, the combination therapy is used for the treatment of solid tumors having a moderate HA ($HA^{moderate}$ or $HA^{+2}$) to high HA ($HA^{high}$ or $HA^{+3}$) content, for example, solid tumor $HA^{high}$ stromal cancers. Exemplary $HA^{high}$ tumors include, for example, pancreatic tumors, ovarian tumors, lung tumors, colon tumors, prostate tumors, cervical tumors and breast tumors.

In particular, hyaluronan-rich cancers targeted by the provided combination therapy are suited for targeting by an anti-hyaluronan agent, such as a hyaluronan-degrading enzyme. Several hyaluronan-rich cancers have been identified. Hyaluronan-rich tumors include, but are not limited to, prostate, breast, colon, ovarian, stomach, head and neck and other tumors and cancers. In some cases, hyaluronan levels correlate with poor prognosis, for example, decreased survival rate and/or recurrence-free survival rate, metastases, angiogenesis, cancer cell invasion into other tissues/areas, and other indicators of poor prognosis. Such correlation has been observed, for example, in hyaluronan-rich tumors including ovarian cancer, SCC, ISC, prostate cancer, lung cancer, including non-small-cell lung cancer (NSCLC), breast cancer, colon cancer and pancreatic cancer (see, for example, Anttila et al., (2000) *Cancer Research*, 60:150-155; Karvinen et al., (2003) *British Journal of Dermatology*, 148:86-94; Lipponen et al., (2001) *Eur. Journal of Cancer*, 849-856; Pirinen et al., (2001) *Int. J. Cancer*: 95: 12-17; Auvinen et al., (2000) *American Journal of Pathology*, 156(2):529-536; Ropponen et al., (1998) *Cancer Research*, 58: 342-347). Thus, hyaluronan-rich cancers can be treated by administration of an anti-hyaluronan agent, such as a hyaluronidase, to treat one or more symptoms of the cancer.

In the methods provided herein, anti-hyaluronan agents, such as hyaluronan-degrading enzymes, including hyaluronidases, can be used to enhance immune system-based anti-tumor activities promoted by immune system-activating therapeutic agents. For example, hyaluronan-degrading enzymes can enhance a host's anti-tumor immune response by facilitating access of immune system checkpoint inhibitors, such as anti-immune checkpoint protein antibodies, to the tumor site, facilitating infiltration of immune cells, and/or by improving the surface contact between cytotoxic immune cells and the target tumor cells. For example, hyaluronan-degrading enzymes, including hyaluronidases, such as rHuPH20, can be administered to a patient in an amount effective to increase diffusion around the tumor site (e.g., to facilitate circulation and/or concentrations of immuno therapeutic agents and/or immune cells in and around the tumor site), inhibit tumor cell motility, such as by hyaluronic acid degradation, and/or to lower the tumor cell apoptosis threshold. This can bring the tumor cell(s) to a state of anoikis, which renders the tumor cell more susceptible to the lymphocytic lysis and/or action of therapeutic agents, including additional therapeutic agents.

In some examples, the administered hyaluronan-degrading enzyme increases delivery of therapeutic agents (e.g., immune checkpoint inhibitors) to tumors by increasing diffusion around and within the tumor site (e.g., facilitating circulation). (U.S. Pat. Nos. 7,767,429, 8,202,517, U.S. Publ. No. 2010-0003238). Thus, a hyaluronan-degrading enzyme, such as PH20, can be administered to a patient in an amount effective to increase diffusion around the tumor site to improve access of an immune checkpoint inhibitor, such as an anti-immune checkpoint protein antibody, administered in combination with (e.g., after) the hyaluronan-degrading enzyme, into the tumor site, where it can activate immune cells, such as lymphocytes, residing in the tumor.

In other examples, hyaluronan-degrading enzyme-mediated increases in circulation around and through the tumor site also can facilitate infiltration of immune cells, such as tumor infiltrating lymphocytes (TILs), into the tumor (Singh et al., (2012) *Clin Cancer Res.* 18:B6; Singh et al., (2013) *Cancer Res.* 73(8 Supplement):4999). Thus, immune checkpoint protein inhibiting agent(s), when administered with the hyaluronan-degrading enzyme, and generally after the hyaluronan-degrading enzyme, can activate immune cells that have infiltrated to the tumor following hyaluronan degradation by the hyaluronan-degrading enzyme, to effect an anti-tumor immune response.

In other examples, hyaluronan degradation, by hyaluronan-degrading enzymes, can facilitate lymphocytic cytotoxic lysis of cancer cells by improving the surface contact between immune cells and the target tumor cells (McBride & Bard (1979) *J Exp Med.* 149(2):507-515). Such activity further promotes an anti-tumor response as a result of administering a combination therapy provided herein.

2. Selection of Subjects for Treatment

The methods of administering a combination therapy provided herein to treat cancer include steps for selecting subjects for treatment that have a tumor or cancer that is characterized as having a moderate to high content of HA. Such methods include methods for detecting levels of HA in the tumors of potential subjects to identify subjects, with tumors characterized by a moderate to high HA content that are likely to respond to treatment of combinatorial administration of an anti-hyaluronan agent, such as a hyaluronan-degrading enzyme, and an immune checkpoint inhibitor, such as an anti-immune checkpoint protein antibody. Any sample or tissue from a subject can be tested and compared to a normal sample or tissue. Hyaluronan levels can be measured from any source such as from a tissue (e.g., by biopsy), tumor, cells, or from blood, serum, urine or other body fluids. The choice of sample is within the level of one of skill in the art.

In other examples, subjects selected for treatment in the methods provided herein exhibit markers of an existing elevated immune response. In some examples the elevated immune response is indicated by an increase in the absolute lymphocyte count (ALC).

a. Measuring Hyaluronan Content of Tumors

It is within the level of one of skill in the art to assess, quantify, determine and/or detect hyaluronan levels in a sample. Hyaluronan content can be measured, for example in a tissue, cell or fluid sample collected from a potential subject. In particular examples, hyaluronan content is measured in tumor tissues, for example in tumor biopsies. For example, such methods include immunostaining by immunohistochemistry or immunofluorescence or solid phase binding assays.

Methods of selecting subjects based on the degree of hyaluronan accumulation (e.g., moderate to high) are known in the art (see e.g., U.S. Patent Publ. No. 2013/0202583; Jiang et al. (2012) Anticancer Res., 32:1203-1212; Kultti et al. (2012) Cancers, 4:873-903; and Jacobetz et al. (2012) Gut, 62:112-120). In such methods, a hyaluronan binding protein (HABP) can be employed to detect hyaluronan.

In a further example, hyaluronan expression and production in tumor cells in vitro can be determined by assessing hyaluronan synthase production (e.g., HAS1, HAS2 or HAS3) and/or expression by cells in vitro, ex vivo or in vivo also can be assayed by, for example, ELISA, SDS-PAGE, Western Blot, PCR, RT-PCR, immunohistochemistry, histology or flow cytometry.

Assays include in vitro or in vivo assays. Exemplary binding assays that can be used to assess, evaluate, determine, quantify and/or otherwise specifically detect hyaluronan expression or levels in a sample include, but are not limited to, solid phase binding assays (e.g., enzyme linked immunosorbent assay (ELISA)), radioimmunoassay (RIA), immunoradiometric assay, fluorescence assay, chemiluminescent assay, bioluminescent assay, western blot and histochemistry methods, such as immunohistochemistry (IHC) or pseudo immunohistochemistry using a non-antibody binding agent. In solid phase binding assay methods, such as ELISA methods, for example, the assay can be a sandwich format or a competitive inhibition format. In other examples, in vivo imaging methods can be used.

It is understood that the particular change, e.g., increase in or decrease in HA, is dependent on the assay used. For example, in an ELISA, the fold increase or decrease in absorbance at a particular wavelength or in quantity of protein (e.g., as determined by using a standard curve) can be expressed relative to a control. In a PCR assay, such as RT-PCR, the change can be compared to control expression levels (e.g., expressed as fold change) using methods known to those in the art, such as using standards.

For example, when the amount of hyaluronan in a sample from a subject is being tested, detection of the marker can be determining that the amount of HA in the sample (e.g., cancerous cell, tissue or fluid) from the subject is elevated compared to a control sample, such as a control sample described in the previous paragraph. In one example, the cancer is determined to be a hyaluronan-rich cancer if the amount of HA in the tissue, cell or fluid is elevated at or about 0.5-fold, 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 20-fold, or more, compared to the control sample. For example, HA high tumors generally exhibit at least 2-fold or more increased HA than a control sample (e.g., tumor). The control sample can be the sample treated with a hyaluronidase to digest the HA and confirm the specificity of staining. In other cases, the control sample can include, but is not limited to, a fluid, tissue, extract (e.g., cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines.

i. Hyaluronan Binding Protein (HABP)

Subjects can be selected by detecting binding of an HABP (also referred to as hyaladherins) to a sample. The HABP can be a hyaluronic acid binding protein from bovine nasal cartilage (e.g., the commercially available HABP from EMD Millipore, Billerica, Mass. as Cat. No. 385911). The HABP also can be any protein that contains a link module or G1 domains, which are domains known to bind to hyaluronan, or multimers thereof containing two or more of such domains. Such proteins are known and are described in U.S. Patent Publ. No. 2013/0202583. An example of such an protein is TSG-6 or TSG-6 link module (TSG-6-LM), or variants thereof that exhibit reduced binding to heparin, or multimers thereof. For detection, the HABP can be detectably labeled. For example, the HABP can be biotinylated.

In particular examples, the HABP is a multimer as described in U.S. Patent Publ. No. 2013/0202583. An HABP multimer is a binding molecule that contains at least two HA binding sites or domains (e.g., at least two link modules) that are each capable of binding to HA. Hence, a multimer typically has a binding affinity, when represented as the dissociation constant (Kd), that is generally less than or less than or $1 \times 10^{-8}$M to $1 \times 10^{-10}$ M, such as less than or $9 \times 10^{-9}$M, $8 \times 10^{-9}$M, $7 \times 10^{-9}$M, $6 \times 10^{-9}$M, $5 \times 10^{-9}$M, $4 \times 10^{-9}$M, $3 \times 10^{-9}$M, $2 \times 10^{-9}$M, $1 \times 10^{-9}$M, $9 \times 10^{-10}$ M, $8 \times 10^{-10}$ M, $7 \times 10^{-10}$ M, $6 \times 10^{-10}$ M, $5 \times 10^{-10}$ M, $4 \times 10^{-10}$ M, $3 \times 10^{-10}$ M, $2 \times 10^{-10}$ M, $1 \times 10^{-10}$ M or lower Kd.

The multimer can be formed from a fusion protein containing an HA binding site (e.g., G1 domain or link module) linked directly or indirectly to a multimerization domain. The multimerization domain provides for the formation of a stable protein-protein interaction between the multimerization domain of a first HABP polypeptide and the multimerization domain of a second HABP polypeptide. The first and second HABP polypeptide (e.g., containing a link domain or G1 domain) can be the same or different. For example, the multimer can be formed by expression of the fusion protein in a cell. The resulting HABP-multimerization domain chimeric proteins can be expressed in host cells transformed with the recombinant expression vector, and allowed to assemble into multimers, where the multimerization domains interact to form multivalent polypeptides. Chemical linkage of multimerization domains to HABP polypeptides can be effected using heterobifunctional linkers as discussed above.

The resulting chimeric polypeptides, and multimers formed therefrom, can be purified by any suitable method such as, for example, by affinity chromatography over Protein A or Protein G columns. Where two nucleic acid molecules encoding different HABP chimeric polypeptides are transformed into cells, formation of homo- and heterodimers will occur. Conditions for expression can be adjusted so that heterodimer formation is favored over homodimer formation.

An exemplary HABP is TSG-6, or a polypeptide containing a link module of TSG-6 (i.e., TSG-6-LM), a sufficient portion of a link module to bind to HA, variants thereof or a multimer thereof. Tumor necrosis factor-Stimulated Gene-6 (TSG-6, tumor necrosis factor alpha-induced protein 6, TNFAIP6; SEQ ID NO: 303) is a ~35 kDa secreted glycoprotein composed of a single N-terminal link module and C-terminal CUB domain. Expression of TSG-6 is induced in many cell types by inflammatory mediators, including cytokines and growths factors. Via its link module, TSG-6 is a potent inhibitor of polymorphonuclear leukocyte migration. TSG-6 forms a stable complex with the serine protease inhibitor Inter-alpha-Inhibitor (IαI) and potentiates the anti-plasmin activity of IαI. TSG-6 also is important for the formation and remodeling of HA-rich pericellular coats and extracellular matrices.

The human TSG-6 transcript (SEQ ID NO: 302) is normally translated to form a 277 amino acid precursor peptide (SEQ ID NO: 303) containing a 17 amino acid signal sequence at the N-terminal. The mature TSG-6 (set forth in SEQ ID NO: 304), therefore, is a 260 amino acid protein containing amino acids 18-277 of SEQ ID NO: 303 (Lee et al. (1992) *J Cell Biol* 116:545-557). TSG-6 is composed of two main domains, the link module and the CUB domain. The link module of TSG-6 is variously reported in the literature to be located at amino acids 35-129, 36-128, 36-129 or 36-132 of SEQ ID NO: 303 (set forth as SEQ ID NOS: 305, 306, 307 or 308, respectively). It is understood that reference to loci of a domain can vary by several amino acids due to differences in alignments. Hence, for purposes herein, a TSG-6-LM is one set forth in any of SEQ ID NOS: 305-308 or that varies from such sequence by one, two or three amino acids. The CUB domain is located at amino acids 135-246 of SEQ ID NO: 303. Human TSG-6 has two potential N-linked glycans at residues N118 and N258 of SEQ ID NO: 303. In addition, residues T259 and T262 of SEQ ID NO: 303 are phosphorylated (Molina et al. (2007) *Proc Natl Acad Sci USA* 104:2199-2204). Human TSG-6 has eight native cysteines which form four disulfide bonds at residues C58-C127, C82-C103, C135-C161 and C188-C210 of preprotein TSG-6 (SEQ ID NO: 303).

TSG-6 link module (e.g., SEQ ID NO: 305-308) has a relatively small size and a well-characterized structure. The three dimensional structure of the TSG-6 link domain was determined and found to have the same fold as other known link modules, containing two alpha helices and two antiparallel beta sheets arranged around a large hydrophobic core (Kohda et al. (1996) *Cell* 86:767-775). In addition, the interaction of the link module of TSG-6 and HA has been studied revealing that the aromatic rings of Tyr12, Tyr59, Phe70, Tyr78, Trp88 and basic residues Lys11, Lys72, Asp77, Arg 81, and Glu86 of the link domain of TSG-6 (SEQ ID NO: 305) are important for binding to HA (see, e.g., Kahmann et al. (2000) *Structure* 15:763-774; Mahoney et al. (2001) *J Biol Chem* 276:22764-22771; Kohda et al. (1996) *Cell*, 88:767-775; Blundell et al. (2003) *J Biol Chem* 278:49261-49270; Lesley et al. (2004) *J Biol Chem* 279: 25745-25754; Blundell et al. (2005) *J Biol Chem* 280: 18189-18201). Structural studies also show that there is only a single HA-binding site contained in the link module, which is localized to one region of the molecule based on the structural map of residues Lys11, Tyr12, Tyr59, Phe70 and Tyr78 that are most directly implicated in HA binding (see e.g., Mahoney et al. (2001) *J Biol Chem* 276:22764-22771).

The link module of TSG-6 exhibits binding activity to several glycosaminoglycans. For example, studies have revealed binding of the link module to HA, chondroitin-4-sulphate (C4S), G1-domain of the proteoglycan aggrecan, heparin and the bikunin chain of IαI (see e.g., Milner et al. (2003) *Journal of Cell Science*, 116:1863-1873; Mahoney et al. (2005) *Journal of Biological Chemistry*, 280:27044-27055). The binding of TSG-6 to heparin and HA is mediated by a distinct binding site in the LM of TSG-6. The residues involved in TSG-6-LM binding to hyaluronan are Lys11, Tyr12, Tyr59, Phe70 and Tyr78, whereby the mutants K11Q, Y12F, Y59F, F70V and Y78F have between 10- and 100-fold lower HA-binding affinity compared to wildtype; the residues in the TSG-6-LM involved in binding to heparin are Lys20, Lys34, Lys41, Lys54, Arg56 and Arg84, whereby the mutants K20A, K34A, K41A and K54A exhibit impaired heparin binding properties; and the residues involved in TSG-6-LM binding to bikunin is overlapping with but not identical to the HA binding site (Mahoney et al. (2005) *Journal of Biological Chemistry*, 280:27044-27055).

Binding of TSG-6 to hyaluronan is pH dependent, with binding activity exhibited at acidic pH of about or pH 5.6 to 6.4, such as or about pH 5.8 to pH 6.0.

TSG-6 polypeptides, HA binding domains thereof, e.g., TSG-6 link modules, or fragments thereof sufficient to bind to HA provided herein for use as a companion diagnostic can include any of SEQ ID NOS: 303-308, or variants thereof such as variants that exhibit at least 65%, 70%, 75%, 80%, 85%, 90%, 91%, 92%, 93%, 94%, 95%, 96%, 97%, 98%, 99% or more sequence identity to any one of SEQ ID NOS: 303-308. Exemplary variants include, for example, species variants, allelic variants and variants that contain conservative and non-conservative amino acid mutations. Natural allelic variants of human TSG-6 include, for example, TSG-6 containing the amino acid replacement Q144R (Nentwich et al. (2002) *J Biol Chem* 277:15354-15362). TSG-6 is highly conserved among species with mouse and human protein being >94% identical.

Variants of TSG-6 or HA binding fragments thereof for use in the provided methods include variants with an amino acid modification that is an amino acid replacement (substitution), deletion or insertion. Exemplary modifications are amino acid replacements such as an amino acid replacement at any of amino acid residues 4, 6, 8, 13, 20, 29, 34, 41, 45, 54, 67, 72 or 96 corresponding to residues in the TSG-6 set forth in SEQ ID NO: 305. The replacement amino acid can be to any other amino acid residue. Exemplary amino acid replacements of a TSG-6 polypeptides or HA binding fragments thereof provided herein for use as a companion diagnostic reagent include modified TSG-6 polypeptides or HA-binding fragments thereof that contain at least one amino acid replacement corresponding to H4K, H4S, E6A, E6K, RBA, K13A, K20A, H29K, K34A, K41A, H45S, K54A, N67L, N67S, K72A, H96K, K34A/K54A or K20A/K34A/K41A corresponding to residues in the TSG-6 set forth in SEQ ID NO: 305 (see, e.g., Mahoney et al. (2005) *J Biol Chem* 280:27044-27055, Blundell et al. (2007) *J Biol Chem* 282:12976-12988, Lesley et al. (2004) *J Biol Chem* 279:25745-25754, Kahmann et al. (2000) *Structure* 15:763-774). It is understood that residues important or otherwise required for the binding of TSG-6 to HA, such as any described above or known to one of skill in the art, are generally invariant and cannot be changed. Thus, for example, amino acid residues 11, 12, 59, 70, 78 and 81 of SEQ ID NO: 305 in the link module of TSG-6 are generally invariant and are not altered. Further, it is understood that amino acid modifications that result in improper folding or perturbation of the folding of the link module are generally invariant. Thus, for example, a modified TSG-6 will not contain any one or more of the amino acid modifications H4S, H29A, H45A, H45K, R56A, D77A, R84A and D89A of SEQ ID NO: 305 (Mahoney et al. (2005) *J Biol Chem* 280:27044-27055, Blundell et al. (2007) *J Biol Chem* 282: 12976-12988, Lesley et al. (2004) *J Biol Chem* 279:25745-25754).

In particular, the modification, for example amino acid replacement or replacements, is one that confers an altered, such as improved, activity compared to a TSG-6 not containing the modification. Such variants include those that contain amino acid modifications that enhance the binding affinity of TSG-6 to HA, increase the specificity of TSG-6 for HA, and/or increase the solubility of TSG-6. For example provided herein for use in the methods herein are TSG-6 variants, HA binding domains, or portions thereof sufficient to bind to HA that increase the specificity of TSG-6 for HA by decreasing the binding of TSG-6 to other glycosaminoglycans, including heparin, chondroitin-4-sulfate, heparan sulfate and dermatan sulfate. Binding to the other glycosaminoglycan that is not hyaluronan can be reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more compared to binding of TSG-6-LM not containing the modification. For example, provided herein is a mutant TSG-6-LM containing amino acid replacement(s) at amino acid residues 20, 34, 41, 54, 56, 72 and/or 84, and in particular at amino acid residues 20, 34, 41, and/or 54 (corresponding to amino acid residues set forth in SEQ ID NO: 303). The replacement amino acid can be to any other amino acid residue, and generally is to a non-basic amino acid residue. For example, amino acid replacement can be to Asp (D), Glu (E), Ser (S), Thr (T), Asn (N), Gln (Q), Ala (A), Val (V), Ile (I), Leu (L), Met (M), Phe (F), Tyr (Y) or Trp (W). The amino acid replacement or replacements confer decreased binding to heparin. For example, variants that decrease the ability of TSG-6 to bind to heparin are known to one of skill in the art. Such variants are those that include at least one mutation corresponding to K20A, K34A, K41A and K54A, including variants K34A/K54A or K20A/K34A/K41A (Mahoney et al. (2005) *J Biol Chem* 280:27044-27055). Exemplary variants that decrease or reduce binding to heparin are variant TSG-6-LM set forth in SEQ ID NO: 309 or 310.

An exemplary TSG-6 polypeptide as a companion diagnostic is a TSG-6 polypeptide that contains at least an HA binding domain, for example, a TSG-6 link module. Thus, provided herein is a TSG-6 link module, or variant thereof, for use in the provided methods. An example of such a polypeptide reagent is one that has a sequence of amino acids set forth in SEQ ID NO: 305-310, or has a sequence of amino acids that exhibits at least 65%, 70%, 75%, 80%, 85%, 90%, 91%, 92%, 93%, 94%, 95%, 96%, 97%, 95%, 99% or more sequence identity to any of SEQ ID NOS: 305-310. For example, the TSG-6 link module can be modified to alter its specificity, affinity or solubility, as long as it retains its ability to bind to HA.

In yet another example, the affinity of the TSG-6 link module is increased by dimerization or multimerization, such as, for example, by fusion to a multimerization domain, such as an Fc domain. Hence, the TSG-6 link module can be modified to produce a multimer containing two or more link modules that are linked directly or indirectly via a multimerization domain to effect the formation of dimer or trimer molecules and the generation of multiple HA binding sites. For example, a companion diagnostic is one that is generated by expression of a nucleic acid molecule encoding the link module set forth in any one of SEQ ID NOS: 305-310 or a nucleic acid encoding a link module having a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 305-310 linked directly or indirectly to a nucleic acid encoding a multimerization domain, such as an Fc portion of an immunoglobulin. Hence, the resulting TSG-6-LM multimer contains a first polypeptide set forth in any one of SEQ ID NOS: 305-310 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 305-310 linked directly or indirectly to a multimerization domain; and a second polypeptide set forth in any one of SEQ ID NOS: 305-310 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 305-310 linked directly or indirectly to a multimerization domain. Generally, the LM or sufficient portion thereof to effect HA binding is the only TSG-6 portion of the multimer.

Exemplary HABP-Fc chimeric polypeptides include fusion protein of the TSG-6 link module (TSG-6-LM) and Fc. For example, the TSG-6-LM:Fc molecule can be one set forth in SEQ ID NO: 312 or 313. An exemplary TSG-6-LM-Fc is set forth in SEQ ID NO: 312, and encoded by a sequence of nucleotides set forth in SEQ ID NO: 314 or 316. An exemplary TSG-6-LM-Fc is set forth in SEQ ID NO: 313, and encoded by a sequence of nucleotides set forth in SEQ ID NO: 315. In addition, HABP-Fc molecules, including for example the exemplary TSG-6-Fc molecules, can optionally contain an epitope tag or a signal for expression and secretion. For example, the exemplary TSG-6-LM-Fc chimeric polypeptide set forth as SEQ ID NO: 312 contains human immunoglobulin light chain kappa (κ) leader signal peptide sequence, an Fc fragment of the human IgG1 heavy chain (SEQ ID NO: 311) and a human TSG-6 link module (SEQ ID NO: 306). The cDNA sequence encoding the TSG-6-LM-Fc chimeric polypeptide is set forth in SEQ ID NO: 314.

ii. Histochemical and Immunohistochemical Methods

Hyaluronan levels in a collected sample, such as a sample from a tumor, can be measured based on the ability of an HABP to bind to HA in a sample and detecting the HABP, such that the amount of the HABP companion diagnostic detected correlates with amount of HA in the sample. Any HABP companion diagnostic can be used to detect HA using tissue staining methods known to one of skill in the art, including but not limited to, cytochemical or histochemical methods, such as immunohistochemistry (IHC) or histochemistry using a non-antibody binding agent (e.g., pseudo immunohistochemistry). Such histochemical methods permit quantitative or semi-quantitative detection of the amount of HABP that binds to HA in a sample, such as a tumor tissue sample. In such methods, a tissue sample can be contacted with an HABP reagent provided herein, and in particular one that is detectably labeled or capable of detection, under conditions that permit binding to tissue- or cell-associated HA.

A sample for determining HA levels by histochemistry can be any biological sample that can be analyzed for its HA levels, such as a tissue, such as a tumor tissue, or cellular sample. For example, a tissue sample can be solid tissue, including a fresh, frozen and/or preserved organ or tissue sample or biopsy or aspirate, or cells. In some examples, the tissue sample is tissue or cells obtained from a solid tumor, such as primary and metastatic tumors, including but not limited to, breast, colon, rectum, lung, stomach, ovary, cervix, uterus, testes, bladder, prostate, thyroid and lung cancer tumors. In particular examples, the sample is a tissue sample from a cancer that is a late-stage cancer, a metastatic cancer, undifferentiated cancer, ovarian cancer, in situ carcinoma (ISC), squamous cell carcinoma (SCC), prostate cancer, pancreatic cancer, non-small cell lung cancer, breast cancer, colon cancer. In other examples, the tissue sample contains cells from primary or cultured cells or cell lines. Cells may be have various states of differentiation, and may be normal, pre-cancerous or cancerous, may be fresh tissues, dispersed cells, immature cells, including stem cells, cells of intermediate maturity and fully matured cells. Typically, the cells selected for use in the methods provided herein are cancer cells.

When the tumor is a solid tumor, isolation of tumor cells is typically achieved by surgical biopsy. Biopsy techniques that can be used to harvest tumor cells from a subject include, but are not limited to, needle biopsy, CT-guided needle biopsy, aspiration biopsy, endoscopic biopsy, bronchoscopic biopsy, bronchial lavage, incisional biopsy, excisional biopsy, punch biopsy, shave biopsy, skin biopsy, bone marrow biopsy, and the Loop Electrosurgical Excision Procedure (LEEP). Typically, a non-necrotic, sterile biopsy or specimen is obtained that is greater than 100 mg, but which can be smaller, such as less than 100 mg, 50 mg or less, 10 mg or less or 5 mg or less; or larger, such as more than 100 mg, 200 mg or more, or 500 mg or more, 1 g or more, 2 g or more, 3 g or more, 4 g or more or 5 g or more. The sample size to be extracted for the assay can depend on a number of factors including, but not limited to, the number of assays to be performed, the health of the tissue sample, the type of cancer, and the condition of the subject. The tumor tissue is placed in a sterile vessel, such as a sterile tube or culture plate, and can be optionally immersed in an appropriate medium.

Tissue obtained from the patient after biopsy is often fixed, usually by formalin (formaldehyde) or glutaraldehyde, for example, or by alcohol immersion. For histochemical methods, the tumor sample can be processed using known techniques, such as dehydration and embedding the tumor tissue in a paraffin wax or other solid supports known to those of skill in the art (see Plenat et al., (2001) Ann Pathol January 21(1):29-47), slicing the tissue into sections suitable for staining, and processing the sections for staining according to the histochemical staining method selected, including removal of solid supports for embedding by organic solvents, for example, and rehydration of preserved tissue. Thus, samples for use in the methods herein can contain compounds that are not naturally present in a tissue or cellular sample, including for example, preservatives, anticoagulants, buffers, fixatives, nutrients and antibiotics.

In exemplary methods to select a subject for treatment with a hyaluronan-degrading enzyme, harvesting of the tumor tissue is generally performed prior to treatment of the subject with a hyaluronan-degrading enzyme. In exemplary methods of monitoring therapy of a tumor with a hyaluronan-degrading enzyme, harvesting of the tumor tissue from the subject can be performed before, during or after the subject has received one or more treatments with a hyaluronan-degrading enzyme.

Assays for measuring HA present in a sample is detected using histochemistry or immunohistochemistry. Histochemistry (HC) is a staining method based on enzymatic reactions using a binding partner, such as an antibody (e.g., monoclonal or polyclonal antibodies) or other binding partner, to detect cells or specific proteins such as tissue antigens, or biomarkers, for example, HA. For example, histochemistry assays include those where an HABP is used as a binding partner to detect HA associated with cells or tissues, particularly cancer tissues. Typically, histochemistry protocols include detection systems that make the presence of the markers visible, to either the human eye or an automated scanning system, for qualitative or quantitative analyses. In a direct HC assay, binding is determined directly upon binding of the binding partner (e.g., first antibody) to the tissue or biomarker due to the use of a labeled reagent. In an indirect HC assay, a secondary antibody or second binding partner is necessary to detect the binding of the first binding partner, as it is not labeled.

In such methods, generally a slide-mounted tissue sample is stained with a labeled binding reagent (e.g., labeled HABP) using common histochemistry techniques. Thus, in some HC assays, the HABP or anti-HA antibody is modified to contain a detectable moiety, such as a fluorescent protein, bioluminescent protein or enzyme. In some examples, the HABP or anti-HA antibody is conjugated to a small molecule, e.g., biotin, that is detected via a labeled binding partner or antibody. In some examples, the IHC method is based on staining with an HABP or antibody that is detected by enzymatic staining with horseradish peroxidase. For example, the HABP or anti-HA antibody can be biotinylated and detected with avidin or streptavidin conjugated to detectable protein, such as streptavidin-horseradish peroxidase. In other examples, the HABP or anti-HA antibody is conjugated to detectable proteins which permit direct detection, such as, for example, HABP companion diagnostics conjugated to a fluorescent protein, bioluminescent protein or enzyme. Various enzymatic staining methods are known in the art for detecting a protein of interest. For example, enzymatic interactions can be visualized using different enzymes such as peroxidase, alkaline phosphatase, or different chromogens such as DAB, AEC or Fast Red. In other examples, the HABP companion diagnostics are conjugated to peptides or proteins that can be detected via a labeled binding partner or antibody.

The resulting stained specimens are each imaged using a system for viewing the detectable signal and acquiring an image, such as a digital image of the staining. Methods for image acquisition are well-known to one of skill in the art. For example, once the sample has been stained, any optical or non-optical imaging device can be used to detect the stain or biomarker label, such as, for example, upright or inverted optical microscopes, scanning confocal microscopes, cameras, scanning or tunneling electron microscopes, canning probe microscopes and imaging infrared detectors.

In some examples, the image can be captured digitally. The obtained images can then be used for quantitatively or semi-quantitatively determining the amount of HA in the sample. Various automated sample processing, scanning and analysis systems suitable for use with immunohistochemistry are available in the art. Such systems can include automated staining and microscopic scanning, computerized image analysis, serial section comparison (to control for variation in the orientation and size of a sample), digital report generation, and archiving and tracking of samples (such as slides on which tissue sections are placed).

Cellular imaging systems are commercially available that combine conventional light microscopes with digital image processing systems to perform quantitative analysis on cells and tissues, including immunostained samples. See, e.g., the CAS-200 system (Becton, Dickinson & Co.). In particular, detection can be made manually or by image processing techniques involving computer processors and software. Using such software, for example, the images can be configured, calibrated, standardized and/or validated based on factors including, for example, stain quality or stain intensity, using procedures known to one of skill in the art (see e.g., published U.S. patent Appl. No. US20100136549).

The image can be quantitatively or semi-quantitatively analyzed and scored based on staining intensity of the sample. Quantitative or semi-quantitative histochemistry refers to method of scanning and scoring samples that have undergone histochemistry, to identify and quantitate the presence of a specified biomarker, such as an antigen or other protein (e.g., HA). Quantitative or semi-quantitative methods can employ imaging software to detect staining densities or amount of staining or methods of detecting staining by the human eye, where a trained operator ranks results numerically. For example, images can be quantitatively analyzed using a pixel count algorithms (e.g., Aperio Spectrum Software, Automated QUantitatative Analysis platform (AQUA® platform), and other standard methods that measure or quantitate or semi-quantitate the degree of staining; see e.g., U.S. Pat. Nos. 8,023,714; 7,257,268; 7,219,016; 7,646,905; published U.S. Pat. Appl. Nos. US20100136549 and 20110111435; Camp et al. (2002) Nature Medicine, 8:1323-1327; Bacus, et al. (1997) Analyt Quant Cytol Histol, 19:316-328). A ratio of strong positive stain (such as brown stain) to the sum of total stained area can be calculated and scored.

Using histochemical, such as immunohistochemical or pseudo immunohistochemical methods, the amount of HA detected is quantified and given as a percentage of HA positive pixels and/or a score. The particular score to select a tumor that expresses moderate to high hyaluronan can be empirically determined, such as based on published or known criteria for scoring tumors for HA. Generally, a tumor cell line known to overexpress HA (such as PC3 xenograft tumor tissue or tumors generated to overexpress HA by expression of HAS2 or HAS3 genes) can serve as a positive control tissue to determine the intensity threshold for positive pixel quantity. HA staining also can be confirmed by digesting a subset of sections with a hyaluronidase before addition of the HABP.

For example, the amount of HA detected in the sample can be quantified as a percentage of HA positive pixels. In some examples, the amount of HA present in a sample is quantified as the percentage of area stained, e.g., the percentage of HA positive pixels. For example, a sample can have at least or about at least or about 0, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 40%, 45%, 50%, 55%, 60%, 65%, 70%, 75%, 80%, 85%, 90%, 95% or more HA positive pixels as compared to the total staining area.

In some examples, a score is given to the sample that is a numerical representation of the intensity or amount of the histochemical staining of the sample, and represents the amount of target biomarker (e.g., HA) present in the sample. Optical density or percentage area values can be given a scaled score, for example on an integer scale, for example, 0-10, 0-5, or 0-3. In particular examples, the amount of hyaluronan in a sample is classified on a scale of 0-3, e.g., 0, HA+1 (low), HA+(moderate), and HA+3 (high). The amount of HA present is relative to the percentage of HA pixels, that is, low percentages of HA pixels indicates a low level of HA whereas high percentages of HA pixels indicate high levels of HA. Scores can be correlated with percentages of HA positive pixels, such that the percentage area that is stained is scored as 0, HA+1, HA+2, and HA+3, representing no staining, less than 10% staining, 10-25% staining or more than 25% staining respectively. For example, if the ratio (e.g., strong pixel stain to total stained area) is more than 25% the tumor tissue is scored as HA+3, if the ratio is 10-25% of strong positive stain to total stain the tumor tissue is scored as HA+2, if the ratio less than 10% of strong positive stain to total stain the tumor tissue is scored as HA+1, and if the ratio of strong positive stain to total stain is 0 the tumor tissue is scored as 0. A score of 0 or HA+1 indicates low levels of HA in the tested sample, whereas a score of HA+2 or HA+3 indicates moderate to high levels of HA in the tested samples.

iii. Solid Phase Binding Assays

Solid-phase binding assays also can be used to quantitatively or semi-quantitatively determine the amount of HA in a sample can be used. Exemplary solid phase binding assays that can be used to assess, evaluate, determine, quantify and/or otherwise specifically detect hyaluronan expression or levels in a sample include, but are not limited to, enzyme linked immunosorbent assay (ELISA), radioimmunoassay (MA), immunoradiometric assay, fluorometric assay, chemiluminescent assay, bioluminescent assay. For example, an HABP or anti-HA antibody can be employed to detect HA using any solid phase binding assay known to one of skill in the art, including but not limited to, enzyme-linked immunosorbent assay (ELISA) or other similar immunoassay, including a sandwich ELISA or competitive ELISA assay. Exemplary methods provided herein include ELISA based methods for quantitative or semi-quantitative detection of the amount of HABP that binds to HA in a sample, such as a tumor tissue sample or fluid sample from a subject having a tumor or suspected of having a tumor. The use of solid phase binding assays can be used when HA is detected in a bodily fluid.

Patients that exhibit high levels of hyaluronan production in the tumor tissue also exhibit high levels of hyaluronan in blood and other fluid samples. Fluid samples for analysis of HA production in an HA-associated disease, such as cancer, include but are not limited to serum, urine, plasma, cerebrospinal fluid, and lymph. The subject can have or be suspected of having a cancer, such as a primary and metastatic tumors, in breast, colon, rectum, lung, stomach, ovary, cervix, uterus, testes, bladder, prostate, thyroid, lung cancer. In particular examples, the cancer is a late-stage cancer, a metastatic cancer, undifferentiated cancer, ovarian cancer, in situ carcinoma (ISC), squamous cell carcinoma (SCC), prostate cancer, pancreatic cancer, non-small cell lung cancer, breast cancer, or colon cancer.

In exemplary methods to select subjects for treatment, collection of a fluid sample from a subject is generally performed prior to treatment of the subject as provided herein. In exemplary methods of monitoring therapy of a tumor with a hyaluronan-degrading enzyme, collection of the fluid sample from a subject can be performed before, during or after the subject has received one or more treatments with a hyaluronan-degrading enzyme. Harvesting of the fluid sample also can be performed before, during, or after the subject has undergone one or more rounds of anti-cancer therapy, such as radiation and/or chemotherapy treatment.

The fluid sample then can be assessed for the presence or amount of HA using a solid-phase binding assay. Solid-phase binding assays can detect a substrate (e.g., HA) in a fluid sample by binding of the substrate to a binding agent that is fixed or immobilized to a solid surface. A substrate-specific antibody or binding protein (e.g., an HABP provided herein), coupled to detectable label (e.g., an enzyme), is applied and allowed to bind to the substrate. Presence of the antibody or bound protein is then detected and quantitated. Detection and quantitation methods include, but are not limited to, colorimetric, fluorescent, luminescent or radioactive methods. The choice of detection method is dependent on the detectable label used. In some examples, a colorimetric reaction employs the enzyme coupled to the antibody. For example, enzymes commonly employed in this method include horseradish peroxidase and alkaline phosphatase. The amount of substrate present in the sample is proportional to the amount of color produced. A substrate standard is generally employed to improve quantitative accuracy. The concentration of HA in a sample can be calculated by interpolating the data to a standard curve. The amount of HA can be expressed as a concentration of fluid sample.

Known methods for detection of hyaluronan-expression in cancer include known assays, including but not limited to, the ELISA-like assay described in Lokeshwar et al., (1997) Cancer Res. 57: 773-777 (see, also, Veiseh et al., (2014) Proc. Natl. Acad. Sci. U.S.A. 29:111(17):E1731-9, which describes a fluorescence-based assay using fluorescently labeled HA; and Published International PCT application No. WO2009/128917) for measuring HA levels in urine or bladder tissue extracts of subjects having bladder cancer. For the assay, urine or extracts are coated on microwell plates (umbilical cord HA used as a standard also is coated), followed by incubation (e.g., 16 hours, room temperature) with a labeled (e.g., biotinylated) HA binding protein, such as those described herein, washed and the HA-binding protein bound to the wells quantified using an avidin-biotin detection agent substrate. Such methods are well-known in the art. In one example, the urine from a subject with an HA-associated bladder cancer contained HA levels that were elevated 2-9 fold compared to urine/extracts from normal patients (healthy subjects or subjects with other gastrourinary diseases or conditions); thus the marker would be detected if the HA levels in the urine was elevated compared to normal subjects, e.g., elevated from between at or about 2-fold and at or about 9-fold, e.g., at or about 2, 3, 4, 5, 6, 7, 8 or 9-fold elevation compared to normal subject.

iv. In Vivo Imaging Assays

In some examples herein, the amount of HA is detected using in vivo imaging methods. In such methods, an HABP, such as TSG-6 or a variant thereof, such as a multimer thereof, or an anti-HA antibody is conjugated to a detectable moiety or moiety that is capable of detection by an imaging method. Exemplary imaging methods include, but are not limited to, fluorescence imaging, X-rays, magnetic resonance methods, such as magnetic resonance imaging (MRI) and magnetic resonance spectroscopy (MRS), and tomographic methods, including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography. For example, for fluorescence imaging, fluorescent signals can be analyzed using a fluorescent microscope or fluorescence stereomicroscope. Also, a low light imaging camera also can be used.

In particular, the HABP or antibody is labeled or conjugated with a moiety that provides a signal or induces a signal that is detectable in vivo, when imaged, such as, but not limited to, magnetic resonance imaging (MRI), single-photon emission computed tomography (SPECT), positron emission tomography (PET), scintigraphy, gamma camera, a β+ detector, a γ detector, fluorescence imaging and bioluminescence imaging. Exemplary imaging/monitoring methods include any of a variety magnetic resonance methods such as magnetic resonance imaging (MRI) and magnetic resonance spectroscopy (MRS), and also include any of a variety of tomographic methods including computed tomography (CT), computed axial tomography (CAT), electron beam computed tomography (EBCT), high resolution computed tomography (HRCT), hypocycloidal tomography, positron emission tomography (PET), gamma rays (after annihilation of a positron and an electron in PET scanning), single-photon emission computed tomography (SPECT), spiral computed tomography and ultrasonic tomography. Other exemplary imaging methods include low-light imaging, X-rays, ultrasound signal, fluorescence absorption and bioluminescence. In addition, the proteins can be labeled with light-emitting or other electromagnetic spectrum-emitting compounds, such as fluorescent compounds or molecules. Detection can be effected by detecting emitted light or other emitted electromagnetic radiation.

Detectable labels include reagents with directly detectable elements (e.g., radiolabels) and reagents with indirectly detectable elements (e.g., a reaction product). Examples of detectable labels include radioisotopes, bioluminescent compounds, chemiluminescent compounds, fluorescent compounds, metal chelates and enzymes. A detectable label can be incorporated into an HABP by chemical or recombinant methods.

Labels appropriate for X-ray imaging are known in the art, and include, for example, Bismuth (III), Gold (III), Lanthanum (III) or Lead (II); a radioactive ion, such as $^{67}$Copper, $^{67}$Gallium, $^{68}$Gallium, $^{111}$Indium, $^{113}$Indium, $^{123}$Iodine, $^{125}$Iodine, $^{131}$Iodine, $^{197}$Mercury, $^{203}$Mercury, $^{186}$Rhenium, $^{188}$Rhenium, $^{97}$Rubidium, $^{103}$Rubidium, $^{99}$Technetium or $^{90}$Yttrium; a nuclear magnetic spin-resonance isotope, such as Cobalt (II), Copper (II), Chromium (III), Dysprosium (III), Erbium (III), Gadolinium (III), Holmium (III), Iron (II), Iron (III), Manganese (II), Neodymium (III), Nickel (II), Samarium (III), Terbium (III), Vanadium (II) or Ytterbium (III); or rhodamine or fluorescein.

Contrast agents are used for magnetic resonance imaging. Exemplary contrast agents include iron, gold, gadolinium and gallium. Labels appropriate for magnetic resonance imaging are known in the art, and include, for example, fluorine, gadolinium chelates, metals and metal oxides, such as for example, iron, gallium, gold, gadolinium, magnesium, $^{1}$H, $^{19}$F, $^{13}$C, and $^{15}$N labeled compounds. Use of chelates in contrast agents is known in the art. Labels appropriate for tomographic imaging methods are known in the art, and include, for example, β-emitters such as $^{11}$C, $^{13}$N, $^{15}$O or $^{64}$Cu or (b) γ-emitters such as 123I. Other exemplary radionuclides that can, be used, for example, as tracers for PET include $^{55}$Co, $^{67}$Ga, $^{68}$Ga, $^{60}$Cu(II), $^{67}$Cu(II), $^{99}$Tc, $^{57}$Ni, $^{52}$Fe and $^{18}$F. The antibody or HABP can be conjugated to a suitable label and/or the protein can include a radiolabel in its constituent molecules.

An exemplary list of nuclides useful for the imaging methods provided herein includes, for example, $^{11}$Carbon, $^{11}$Fluorine, $^{13}$Carbon, $^{13}$Nitrogen, $^{15}$Nitrogen, $^{15}$Oxygen, $^{18}$Flourine, $^{19}$Flourine, $^{24}$Sodium, $^{32}$Phosphate, $^{42}$Potassium, $^{51}$Chromium, $^{55}$Iron, $^{59}$Iron, $^{57}$Cobalt, $^{60}$Cobalt, $^{64}$Copper, $^{67}$Gallium, $^{68}$Gallium, $^{75}$Selenium, $^{81}$Krypton, $^{82}$Rubidium, $^{89}$Strontium, $^{92}$Strontium, $^{90}$Yttirum, $^{99}$Technetium, $^{133}$Palladium, $^{106}$Ruthenium, $^{111}$Indium, $^{117}$Lutetium, $^{123}$Iodine, $^{125}$Iodine, $^{131}$Iodine, $^{133}$Xenon, $^{137}$Cesium, $^{153}$Samarium, $^{153}$Gadolinium, $^{165}$Dysprosium, $^{166}$Holmium, $^{169}$Ytterbium, $^{177}$Leutium, $^{186}$Rhenium, $^{188}$Rhenium, $^{192}$Iridium, $^{198}$Gold, $^{201}$Thallium, $^{211}$Astatine, $^{212}$Bismuth and $^{213}$Bismuth. One of skill in the art can alter the parameters used in different imaging methods (MRI, for example) in order to visualize different nuclides/metals.

Fluorescent labels also can be used. These include fluorescent proteins, fluorescent probes or fluorescent substrate. For example, fluorescent proteins can include, but are not limited to, fluorescent proteins such as green fluorescent protein (GFP) or homologs thereof or RFP; fluorescent dyes (e.g., fluorescein and derivatives such as fluorescein isothiocyanate (FITC) and Oregon Green®, rhodamine and derivatives (e.g., Texas red and tetramethyl rhodamine isothiocyanate (TRITC)), biotin, phycoerythrin, AMCA, Alexa Fluor®, Li-COR®, CyDyes® or DyLight® Fluors); tdTomato, mCherry, mPlum, Neptune, TagRFP, mKate2, TurboRFP and TurboFP635 (Katushka). The fluorescent reagent can be chosen based on user desired excitation and emission spectra. Fluorescent substrates also can be used that result in fluorescent cleavage products.

The in vivo imaging methods can be used in the diagnosis of HA-associated tumors or cancers. Such a technique permits diagnosis without the use of biopsy. In vivo imaging methods based on the extent or level of binding of an HABP to a tumor also can be used for prognoses to cancer patients. The in vivo imaging methods also can be used to detect metastatic cancers in other parts of the body or circulating tumor cells (CTCs). It is within the level of one of skill in the art to ascertain background levels of hyaluronan in tissues other than tumors. Hyaluronan-expressing tumors will have higher levels of signal than background tissues. In some examples, threshold criteria can be determined by comparisons to signal detected in normal or healthy subjects.

b. Pre-Treatment Lymphocyte Count

The combination therapy provided herein initiates an immune response, at least in part, by blocking immune checkpoint proteins to treat cancers, in particular, cancers characterized by having a moderate to high HA content. Because the immune response activation relies on lymphocytes, absolute lymphocyte count (ALC) can be used among the selection criteria for subjects to receive the combination therapy provided herein. The ALC and methods for determining ALC are described elsewhere herein (for monitoring response to the combination therapies provided herein). A normal ALC, in a non-diseased individual, ranges from 800/mL to 3,500/mL. Subjects selected for treatment using the provided combination therapy typically exhibit within or approximately within the normal range of ALC prior to selection. For example, a subject selected for the combination therapy provided herein typically have an ALC of at least 800/mL, such as 800/mL, 900/mL, 1,000/mL, 1,250/mL, 1,500/mL, 2,000/mL, 2,500/mL, 3,000/mL or 3,500/mL. In particular examples, subjects selected for the combination therapy provided herein have an ALC of at least 1,000/mL.

3. Dosage and Administration

The combination therapy provided herein, containing a polymer-conjugated anti-hyaluronan agent, such as a hyaluronan-degrading enzyme, and an immune checkpoint inhibitor, such as an anti-immune checkpoint protein antibody (e.g., an anti-CTLA4 or anti-PD-1 antibody), is administered in an amount sufficient to exert a therapeutically useful effect. Typically, the active agents are administered in an amount that does not result in undesirable side effects of the patient being treated, or that minimizes or reduces the observed side effects as compared to dosages and amounts required for single treatment with one of the above agents. For example, as described elsewhere herein, it is found herein that the combination therapy with a polymer-conjugated hyaluronan-degrading enzyme and an immune checkpoint inhibitor, such an anti-immune checkpoint protein antibody results in decreased tumor progression compared to administration of vehicle or either agent alone. Thus, it is possible, the amount of an immune checkpoint inhibitor, such as an anti-immune checkpoint protein antibody, that can be administered in the combination therapy provided herein, compared to the amounts of the immune checkpoint inhibitor (e.g., anti-immune checkpoint protein antibody) administered using prior art methods is reduced, while achieving substantially the same or improved therapeutic efficacy. By virtue of the decreased dosage that can be administered, side effects associated with anti-immune checkpoint protein antibody administration, such as immune-related adverse events, described elsewhere herein, are reduced, minimized or avoided.

It is within the level of one of skill in the art to determine the precise amounts of active agents, including anti-hyaluronan agent, e.g., polymer-conjugated hyaluronan-degrading enzyme and immune checkpoint inhibitor to be administered to a subject. For example, such agents and uses for treating cancers and solid tumors, are well-known in the art. Thus, dosages of such agents in a composition or combination therapy can be chosen based on standard dosing regimens for that agent under a given route of administration.

It is understood that the precise dosage and duration of treatment is a function of the tissue or tumor being treated and may be determined empirically using known testing protocols or by extrapolation from in vivo or in vitro test data and/or can be determined from known dosing regimens of the particular agent. It is to be noted that concentrations and dosage values may also vary with the age of the individual treated, the weight of the individual, the route of administration and/or the extent or severity of the disease and other factors that are within the level of a skilled medical practitioner to consider. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects). It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof.

For example, the polymer-conjugated hyaluronan-degrading enzyme, such as a hyaluronidase for example a PH20 (e.g., PEGPH20), is administered in a therapeutically effective amount to degrade or cleave tumor-associated hyaluronan. The amount of a hyaluronan-degrading enzyme, such as a soluble hyaluronidase, to be administered for the treatment of a disease or condition, for example a cancer or solid tumor such as an HA-rich tumor, can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease. Exemplary dosage range is at or about 50 Units to 50,000,000 Units of a hyaluronan-degrading enzyme conjugated to a polymer, or a functionally equivalent amount of another hyaluronan-degrading enzyme conjugated to a polymer. It is understood herein that a unit of activity is normalized to a standard activity, for example, an activity as measured in a microturbidity assay assaying hyaluronidase activity.

Thus, for example, a hyaluronan-degrading enzyme, such as a hyaluronidase for example a PH20, conjugated to polymer, for example, a PEG can be administered at or about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 Units. Generally, a polymer-conjugated hyaluronan-degrading enzyme is administered to a subject in an amount that is between or about between 0.01 µg/kg to 25 mg/kg, such as 0.0005 mg/kg (0.5 µg/kg) to 25 mg/kg, 0.5 µg/kg to 10 mg/kg, 0.02 mg/kg to 1.5 mg/kg, 0.01 µg/kg to 15 µg/kg, 0.05 µg/kg to 10 µg/kg, 0.75 µg/kg to 7.5 µg/kg or 1.0 µg/kg to 3.0 µg/kg. For example, the dosage range amount can be between or about between 0.01 µg/kg to 100 µg/kg (of the subject), 0.01 µg/kg to 50 µg/kg, 0.01 µg/kg to 15 µg/kg, 0.05 µg/kg to 10 µg/kg, 0.75 µg/kg to 7.5 µg/kg, 1.0 µg/kg to 5.0 or 1.0 µg/kg to 3.0 µg/kg of the subject. The polymer-conjugated hyaluronan-degrading enzyme can be administered, for example, at a dosage of at least or about at least 0.00001 mg/kg (0.01 µg/kg) of the subject, such as 0.0005 mg/kg, 0.0006 mg/kg, 0.0007 mg/kg, 0.0008 mg/kg, 0.0009 mg/kg, 0.001 mg/kg, 0.0016 mg/kg, 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.016 mg/kg, 0.02 mg/kg, 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg·kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 21 mg/kg, 22 mg/kg, 23 mg/kg, 24 mg/kg, 25 mg/kg, or more is administered, to an average adult human subject, typically weighing about 70 kg to 75 kg.

A polymer-conjugated hyaluronan-degrading enzyme, such as a PEGylated hyaluronidase (e.g., PEGPH20), provided herein is administered at greater than 0.5 Units/kg, such as between or about between 1 Unit/kg to 800,000 Units/kg, such as 10 to 800,000 Units/kg, 10 to 750,000 Units/kg, 10 to 700,000 Units/kg, 10 to 650,000 Units/kg, 10 to 600,000 Units/kg, 10 to 550,000 Units/kg, 10 to 500,000 Units/kg, 10 to 450,000 Units/kg, 10 to 400,000 Units/kg, 10 to 350,000 Units/kg, 10 to 320,000 Units/kg, 10 to 300,000 Units/kg, 10 to 280,000 Units/kg, 10 to 260,000 Units/kg, 10 to 240,000 Units/kg, 10 to 220,000 Units/kg, 10 to 200,000 Units/kg, 10 to 180,000 Units/kg, 10 to 160,000 Units/kg, 10 to 140,000 Units/kg, 10 to 120,000 Units/kg, 10 to 100,000 Units/kg, 10 to 80,000 Units/kg, 10 to 70,000 Units/kg, 10 to 60,000 Units/kg, 10 to 50,000 Units/kg, 10 to 40,000 Units/kg, 10 to 30,000 Units/kg, 10 to 20,000 Units/kg, 10 to 15,000 Units/kg, 10 to 12,800 Units/kg, 10 to 10,000 Units/kg, 10 to 9,000 Units/kg, 10 to 8,000 Units/kg, 10 to 7,000 Units/kg, 10 to 6,000 Units/kg, 10 to 5,000 Units/kg, 10 to 4,000 Units/kg, 10 to 3,000 Units/kg, 10 to 2,000 Units/kg, 10 to 1,000 Units/kg, 10 to 900 Units/kg, 10 to 800 Units/kg, 10 to 700 Units/kg, 10 to 500 Units/kg, 10 to 400 Units/kg, 10 to 300 Units/kg, 10 to 200 Units/kg, 10 to 100 Units/kg, 16 to 600,000 Units/kg, 16 to 500,000 Units/kg, 16 to 400,000 Units/kg, 16 to 350,000 Units/kg, 16 to 320,000 Units/kg, 16 to 160,000 Units/kg, 16 to 80,000 Units/kg, 16 to 40,000 Units/kg, 16 to 20,000 Units/kg, 16 to 16,000 Units/kg, 16 to 12,800 Units/kg, 16 to 10,000 Units/kg, 16 to 5,000 Units/kg, 16 to 4,000 Units/kg, 16 to 3,000 Units/kg, 16 to 2,000 Units/kg, 16 to 1,000 Units/kg, 16 to 900 Units/kg, 16 to 800 Units/kg, 16 to 700 Units/kg, 16 to 500 Units/kg, 16 to 400 Units/kg, 16 to 300 Units/kg, 16 to 200 Units/kg, 16 to 100 Units/kg, 160 to 12,800 Units/kg, 160 to 8,000 Units/kg, 160 to 6,000 Units/kg, 160 to 4,000 Units/kg, 160 to 2,000 Units/kg, 160 to 1,000 Units/kg, 160 to 500 Units/kg, 500 to 5000 Units/kg, 1000 to 100,000 Units/kg or 1000 to 10,000 Units/kg, of the mass of the subject to whom it is administered. In some examples, a hyaluronan-degrading enzyme, such as a polymer-conjugated hyaluronan-degrading enzyme, such as a PEGylated hyaluronidase (e.g., PEGPH20) can be administered at or about between 0.5 Units/kg to 4,000 Units/kg, 1 Unit/kg to 1000 Units/kg, 1 Units/kg to 500 Units/kg. 5 Units/kg to 500 Units/kg, 10 Units/kg to 500 Units/kg, 20 Units/kg to 400 Units/kg or 10 Units/kg to 50 Units/kg.

Generally, where the specific activity of the PEGylated hyaluronidase is or is about 10,000 U/mg to 80,000 U/mg, such as 20,000 U/mg to 60,000 U/mg or 18,000 U/mg to 45,000 U/mg, generally at least or at least about 1 Units/kg (U/kg), 2 U/kg, 3 U/kg, 4 U/kg, 5 U/kg, 6 U/kg, 7 U/kg, 8 U/kg, 8 U/kg 10 U/kg, 16 U/kg, 32 U/kg, 64 U/kg, 100 U/kg, 200 U/kg, 300 U/kg, 400 U/kg, 500 U/kg, 600 U/kg, 700 U/kg, 800 U/kg, 900 U/kg, 1,000 U/kg, 2,000 U/kg, 3,000 U/kg, 4,000 U/kg, 5,000 U/kg, 6,000 U/kg, 7,000 U/kg, 8,000 U/kg, 9,000 U/kg, 10,000 U/kg, 12,800 U/kg, 20,000 U/kg, 32,000 U/kg, 40,000 U/kg, 50,000 U/kg, 60,000 U/kg, 70,000 U/kg, 80,000 U/kg, 90,000 U/kg, 100,000 U/kg, 120,000 U/kg, 140,000 U/kg, 160,000 U/kg, 180,000 U/kg, 200,000 U/kg, 220,000 U/kg, 240,000 U/kg, 260,000 U/kg, 280,000 U/kg, 300,000 U/kg, 320,000 U/kg, 350,000 U/kg, 400,000 U/kg, 450,000 U/kg, 500,000 U/kg, 550,000 U/kg, 600,000 U/kg, 650,000 U/kg, 700,000 U/kg, 750,000 U/kg, 800,000 U/kg or more, per mass of the subject, is administered. For example, at least 1,000 Units (U); 2000 U; 3,000 U; 4,000 U; 5,000 U; 6,000 U; 7,000 U; 8,000 U; 9,000 U; 10,000 U; 20,000 U; 30,000 U; 40,000 U; 50,000 U; 60,000 U; 70,000 U; 80,000 U; 90,000 U; 100,000 U; 200,000 U; 300,000 U; 400,000 U; 500,000 U; 600,000 U; 700,000 U; 800,000 U; 900,000 U; 1,000,000 U; 1,500,000 U; 2,000,000 U; 2,500,000 U; 3,000,000 U; 3,500,000 U; 4,000,000 U or more is administered.

In examples herein, the immune checkpoint inhibitor, such as an anti-immune checkpoint protein antibody is provided in a therapeutically effective amount for the particular dosage regimen. Therapeutically effective concentrations can be determined empirically by testing the compounds in known in vitro and in vivo systems, such as the assays provided herein. The concentration of a selected immune checkpoint inhibitor in the composition depends on absorption, inactivation and excretion rates of the complex, the physicochemical characteristics of the complex, the dosage schedule, and amount administered as well as other factors known to those of skill in the art.

For example, it is understood that the precise dosage and duration of treatment is a function of the type of cancer being treated and may be determined empirically using known testing protocols or by extrapolation from in vivo or in vitro test data. It is to be noted that concentrations and dosage values also may vary with the age of the individual treated. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof.

The amount of a selected immune checkpoint inhibitor to be administered for the treatment of cancers can be determined by standard clinical techniques or other methods as described herein. In addition, in vitro assays and animal models can be employed to help identify optimal dosage ranges. Hence, the precise dosage, which can be determined empirically, can depend on the particular immunoglobulin preparation, the regimen and dosing schedule with the soluble hyaluronidase, the route of administration, the type of cancer to be treated and the progression of the disease. Exemplary dosage regimens (doses and frequencies) of immune checkpoint inhibitor formulations for treating cancers are provide below. Other dosage regimens are well-known to those of skill in the art. If necessary, a particular dosage and duration and treatment protocol can be empirically determined or extrapolated.

In some examples, the dose of an immune checkpoint inhibitor is a function of immune cell populations. For example, the dose of the immune checkpoint inhibitor can be modulated to minimize the increase in the number of $T_{reg}$ cells in response to the administered agent. For example a maximum dose can be determined to be the maximum dose that does not result in an increase in the number of circulating $T_{reg}$ cells. In another example, the dose of an immune checkpoint inhibitor can be modulated to maximize the increase in the number of effector cells in the tumor-bearing subject. In a further example, the dose of an immune checkpoint inhibitor is selected that minimizes or prevents and increase in the number of $T_{reg}$ cells, but maximizes the increase in the number of effector cells. Methods for determining such doses are known in the art and described herein. For example, the number(s) of $T_{reg}$ cells and/or effector cells can be measured by flow cytometry (described herein above) at one or more different time points after administration of the immune checkpoint inhibitor. For examples the number(s) of $T_{reg}$ cells and/or effector cells can be determined on the same day as administration and/or 1 day, 2 days, 3 days, 4 days, 5 days, 6 days, 1 week, 2 weeks, 3 weeks, 4 weeks, 5 weeks, 6 weeks, 7 weeks, 8 weeks, 9 weeks, 10 weeks, 11 weeks, 12 weeks or more after administration of the immune checkpoint inhibitor, such as 1 day, 2 days, 3 days, 4 days, 5 days, 6 days, or 1 week after administration of the immune checkpoint inhibitor. The following dose can be modulated to achieve the desired affects with respect to the levels of $T_{reg}$ cells and/or effector cells detected.

In some examples, exemplary doses of intravenously administered immune checkpoint inhibitor, such as an anti-immune checkpoint protein antibody, can be used as a starting point to determine appropriate dosages. Dosage levels can be determined based on a variety of factors, such as body weight of the individual, general health, age, the activity of the specific compound employed, sex, diet, time of administration, rate of excretion, drug combination, the severity and course of the disease, and the patient's disposition to the disease and the judgment of the treating physician. Non-limiting exemplary dosages of the provided immune checkpoint inhibitors are from or about 0.1 mg per kg body weight (mg/kg BW) to about 50 mg/kg BW, such as about 0.1 mg/kg to about 20 mg/kg BW, about 0.1 to about 10 mg/kg BW, about 0.3 to about 10 mg/kg, about 0.5 mg/kg to 5 mg/kg or 0.5 mg/kg to 1 mg/kg. For example, the immune checkpoint inhibitor can be administered to tumor-bearing animals in doses of, for example, at least about 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg·kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 21 mg/kg, 22 mg/kg, 23 mg/kg, 24 mg/kg, 25 mg/kg, 30 mg/kg, 40 mg/kg, 50 mg/kg, or more. In particular, the immune checkpoint inhibitor is administered at a dose of at least 0.1 mg/kg, 0.3 mg/kg, 1 mg/kg, 3, mg/kg, 5 mg/kg, 7.5 mg/kg, 10 mg/kg, or 15 mg/kg. In some examples, exemplary dosages include, but are not limited to, about or 0.01 mg/m$^2$ to about or 500 mg/m$^2$, such as for example, about or 0.01 mg/m$^2$, about or 0.1 mg/m$^2$, about or 0.5 mg/m$^2$, about or 1 mg/m$^2$, about or 5 mg/m$^2$ about or 10 mg/m$^2$, about or 15 mg/m$^2$, about or 20 mg/m$^2$, about or 25 mg/m$^2$ about or 30 mg/m$^2$, about or 35 mg/m$^2$, about or 40 mg/m$^2$, about or 45 mg/m$^2$ about or 50 mg/m$^2$, about or 100 mg/m$^2$, about or 150 mg/m$^2$, about or 200 mg/m$^2$, about or 250 mg/m$^2$, about or 300 mg/m$^2$, about or 400 mg/m$^2$, about or 500 mg/m$^2$. It is understood that one of skill in the art can recognize and convert dosages between units of mg/kg and mg/m$^2$ (see, e.g., Michael J. Derelanko, TOXICOLOGIST'S POCKET HANDBOOK, CRC Press, p. 16 (2000)).

It is understood that the amount to administer will be a function of the type of cancer being treated, the route of administration, and the tolerability of possible side effects. If necessary, dosage can be empirically determined. To achieve such dosages, volumes of immune checkpoint inhibitor-containing formulations administered subcutaneously can be at or about 1 mL to 700 mL, for example, 10 mL to 500 mL, such as 100 mL to 400 mL. For example, volumes of immune checkpoint inhibitor-containing formulations administered subcutaneously can be at least or about at least 1 mL, 2 mL, 3 mL, 4 mL, 5 mL, 10 mL, 20 mL, 30 mL, 40 mL, 50 mL, 100 mL, 200 mL, 300 mL, 400 mL, 500 mL, 600 mL, 700 mL or more for single dosage administration.

In other examples, the dose of the immune checkpoint inhibitor is a low dose, such as less than or equal to 1 mg per administration, for example, less than or equal to 500 µg, 400 µg, 300 µg, 200 µg, 100 µg, 50 µg, 30 µg, 20 µg, 10 µg, 5 µg or 1 µg per administration. It will be appreciated that such low doses can be administered in a suitable volume repeatedly to the patient over time, for example twice daily, once daily, once every other day, twice weekly, once weekly, bimonthly, monthly, etc.

The hyaluronan-degrading enzyme and immune checkpoint inhibitor formulations provided herein can be administered intravenously, subcutaneously, intratumorally, intradermally, orally or by other routes of administration. The particular route can differ between the administered agents or can be the same. For example, one or more, or all agents, can be administered intravenously. In some examples, it is contemplated herein that a polymer-conjugated hyaluronan-degrading enzyme is administered intravenously and the immune checkpoint inhibitor is administered intravenously.

For intravenous administration, one or more, or all, of the agents can be administered by push or bolus, by infusion, or by a combination thereof. The infusion time can be about 1 minute to three hours, such as about 1 minute to about two hours or about 1 minute to about 60 minutes, and generally at least 10 minutes, 40 minutes, or 60 minutes. The agents can be administered by concurrent infusion or by subsequent infusion. For example, the administered agents are administered separately and are provided in separate bags for separate infusions. In particular examples, the hyaluronan-degrading enzyme composition and the immune checkpoint inhibitor composition are formulated and administered separately.

4. Dosage Regimen: Frequency and Cycle of Administration

The anti-hyaluronan agent, such as the polymer-conjugated hyaluronan-degrading enzyme, can be administered prior to, simultaneously with or near simultaneously with, sequentially with or intermittently with the immune checkpoint inhibitor. For example, the hyaluronan-degrading enzyme, e.g., PEGPH20, and the immune checkpoint inhibitor, e.g., an anti-immune checkpoint protein antibody (e.g., an anti-CTLA4 or anti-PD-1 antibody) can be co-administered together or separately.

Generally, the anti-hyaluronan agent, such as a hyaluronan-degrading enzyme, is administered prior to the immune checkpoint inhibitor. For example, the polymer-conjugated hyaluronan-degrading enzyme is administered up to 48 hours prior to administering the immune checkpoint inhibitor. For example, the anti-hyaluronan agent, or hyaluronan-degrading enzyme, is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours, up to 48 hours prior to administration of the immune checkpoint inhibitor.

The frequency and timing of administration, and the dosage amounts, can be administered periodically over a cycle of administration to maintain a continuous and/or long term effect of the active agents for a desired length of time and need not be the same for the hyaluronan-degrading enzyme and immune checkpoint inhibitor. The provided combinations or compositions can be administered hourly, daily, weekly, monthly, yearly or once. The length of time of the cycle of administration can be empirically determined, and is dependent on the disease to be treated, the severity of the disease, the particular patient, and other considerations within the level of skill of the treating physician. The length of time of treatment with a combination therapy provided herein can be one week, two weeks, one months, several months, one year, several years or more.

For example, the frequency of administration of the hyaluronan-degrading enzyme is once a day, every other day, twice weekly, once weekly, once every 2 weeks, once every 3 weeks or once every 4 weeks. The dosages can be divided into a plurality of cycles of administration during the course of treatment. For example, a hyaluronidase enzyme can be administered at the frequency over a period of about a month, 2 months, 3 months, 4 months, 5 months, 6 months, a year or more. The frequency of administration can be the same throughout the period of the cycle or can differ. For example, an exemplary dosage frequency is two times a week at least for a first week of a cycle of administration. After the first week, the frequency can continue at twice a week, can increase to more than twice a week, or can be reduced to no more than once a week. It is within the level of a skilled person to determine the particular dosage frequency and cycle of administration based on the particular dosage being administered, the disease or condition being treated, the severity of the disease or condition, the age of the subject and other similar factors.

The immune checkpoint inhibitor can be administered at the same frequency or at a different frequency, but each administration of the immune checkpoint inhibitor is preceded by an administration of hyaluronan-degrading enzyme by not more than 48 hours. For example, in some examples each dose of hyaluronan-degrading enzyme is followed 24 to 48 hr later by a dose of immune checkpoint inhibitor. In particular examples, the immune checkpoint inhibitor is administered less frequently than the hyaluronan-degrading enzyme, but each dose of immune checkpoint inhibitor is preceded by a dose of hyaluronan-degrading enzyme. For example, the immune checkpoint inhibitor is administered twice weekly, once weekly, once every 2 weeks, once every 3 weeks, once every 4 weeks, once every 6 weeks, once every 2 months, once every 3 months, once every 4 months, once every 5 months, or once every 6 months, and in a manner that is preceded by administration of a hyaluronan-degrading enzyme. In such examples, the dose of hyaluronan-degrading enzyme that precedes the immune checkpoint inhibitor is in sync with the dosage schedule of the hyaluronan-degrading enzyme. Generally, the immune checkpoint inhibitor is administered no more than once a month, such as once every three weeks or once every four weeks.

If disease symptoms persist in the absence of discontinued treatment, treatment can be continued for an additional length of time. Over the course of treatment, evidence of disease and/or treatment-related toxicity or side effects can be monitored.

The cycle of administration, of the hyaluronan-degrading enzyme and/or immune checkpoint inhibitor, can be tailored to add periods of discontinued treatment in order to provide a rest period from exposure to the agents. The length of time for the discontinuation of treatment can be for a predetermined time or can be empirically determined depending on how the patient is responding or depending on observed side effects. For example, the treatment can be discontinued for one week, two weeks, one month or several months. Generally, the period of discontinued treatment is built into a cycle of dosing regimen for a patient.

For example, an exemplary dosing regimen is a treatment cycle or cycle of administration of 28 days. The agent, such as the anti-hyaluronan agent, e.g., a polymer-conjugated hyaluronan-degrading enzyme, can be administered on day 1, followed by administration of the immune checkpoint inhibitor, such as an immune checkpoint protein antibody on day 2, followed by 26 days without dosing. In another example the hyaluronan-degrading enzyme can be administered twice weekly, on days 1, 4, 8, 11, 15, 18, 22 and 25, and the immune checkpoint inhibitor is administered once on day 2. In another example the hyaluronan-degrading enzyme is administered twice weekly, on days 1, 4, 8, 11, 15, 18, 22 and 25 and the immune checkpoint inhibitor also is administered twice weekly on days 2, 5, 9, 12, 16, 19, 23, and 26. It is understood that the above description is for exemplification purposes only and that variations of the above can be employed. Further, similar cycles of administration can be applied to all administered agents, or each administered agent can be employed in its own dosing regimen in the combination therapy provided herein.

It is within the level of one of skill in the art to determine the precise cycle of administration and dosing schedule. As noted above, the cycle of administration can be for any desired length of time. Hence, the 28-day cycle of administration can be repeated for any length of time. It is within the level of skill of the treating physician to adopt a cycle of administration and dosing regimen that meets the needs of the patient depending on personal considerations specific to the patient and disease to be treated.

The provided methods also can include administration of a corticosteroid prior to, concurrent with, intermittently with or subsequent to administration of the anti-hyaluronan agent. The cycle of administration can be for any time period, and is within the level of the treating physician or clinician. Typically, the predetermined number of weeks is 3 weeks or 4 weeks, but can be longer. The cycle of administration can be repeated a plurality of times depending on the disease status and response of the subject.

5. Additional Combination Therapy

The combination therapy provided herein can be used alone and in further combination with other therapies or treatments. The combinations or compositions provided herein can be further co-formulated or co-administered together with, prior to, intermittently with, or subsequent to, other therapeutic or pharmacologic agents or treatments, such as procedures. For example, such agents include, but are not limited to, other biologics, anti-cancer agents, small molecule compounds, dispersing agents, anesthetics, vasoconstrictors and surgery, and combinations thereof. Such agents also can include one or more agents to ameliorate, reduce or prevent side effects. In some cases, the combination therapy can be used in combination with one or more cancer treatments that remove the primary tumor prior to treatment. For example, additional chemotherapy or radiation therapy and combinations thereof can be used in addition to the combination therapy provided herein. In other examples, surgical removal may not be necessary. Exemplary other methods that can be combined include administering a compound that decreases the rate of proliferation of the tumor or neoplastic cells without weakening the immune system (e.g., by administering tumor suppressor compounds or by administering tumor cell-specific compounds) or administering an angiogenesis-inhibiting compound. In a further example, a vaccine can be administered as a part of the combination therapy provided herein. In some examples, the vaccine can be a cytokine-expressing tumor vaccine, such as a GM-CSF-expressing tumor vaccine (see e.g., Jinushi et al., (2007) *J Clin Invest* 117:1902-1913), or a tumor antigen vaccine to further promote an anti-tumor immune response.

A preparation of a second agent or agents or treatment or treatments can be administered at once, or can be divided into a number of smaller doses to be administered at intervals of time. Selected agent/treatment preparations can be administered in one or more doses over the course of a treatment time for example over several hours, days, weeks, or months. In some cases, continuous administration is useful. It is understood that the precise dosage and course of administration depends on the indication and patient's tolerability. Generally, dosing regimens for second agents/treatments herein are known to one of skill in the art.

a. Corticosteroids

The combination therapy provided herein can be used alone or in further combination with one or more corticosteroids. A corticosteroid is administered in an amount that is therapeutically effective to ameliorate or reduce one or more adverse effects of administration of a polymer-conjugated hyaluronan-degrading enzymes or other agent, in particular, adverse musculoskeletal effects that can occur upon systemic administration of a hyaluronan-degrading enzyme, such as a hyaluronidase, and particularly a polymer-modified hyaluronidase, such as a PEGPH20. A therapeutically effective amount is the dosage sufficient to ameliorate, prevent, eliminate or reduce one or more symptoms or adverse effects. Indicators of improvement or successful pretreatment include determination of the failure to manifest a relevant score on the CTCAE scale or a change in grading or severity on the CTCAE scale.

Corticosteroids are a class of steroid hormones that are produced in the adrenal cortex. Corticosteroids are involved in a wide range of physiologic systems such as stress response, immune response and regulation of inflammation, carbohydrate metabolism, protein catabolism, blood electrolyte levels, and behavior. These include glucocorticoids, which are anti-inflammatory agents with a large number of other functions and mineralocorticoids, which control salt and water balance primarily through action on the kidneys.

Glucocorticoids are a class of steroid hormones, e.g., corticosteroids, that bind to the glucocorticoid receptor. Glucocorticoids cause their effects by binding to the glucocorticoid receptor. Among other activities, the activated glucocorticoid complex in turn up-regulates the expression of anti-inflammatory proteins in the nucleus and represses the expression of pro-inflammatory proteins in the cytosol by preventing the translocation of other transcription factors from the cytosol into the nucleus.

Generally, any corticosteroid, e.g., glucocorticoid, can be used in the methods or combinations provided herein. The glucocorticoids include synthetic and non-synthetic glucocorticoids. Exemplary glucocorticoids include, but are not limited to: alclometasones, algestones, beclomethasones (e.g., beclomethasone dipropionate), betamethasones (e.g., betamethasone 17-valerate, betamethasone sodium acetate, betamethasone sodium phosphate, betamethasone valerate), budesonides, clobetasols (e.g., clobetasol propionate), clobetasones, clocortolones (e.g., clocortolone pivalate), cloprednols, corticosterones, cortisones and hydrocortisones (e.g., hydrocortisone acetate), cortivazols, deflazacorts, desonides, desoximetasones, dexamethasones (e.g., dexamethasone 21-phosphate, dexamethasone acetate, dexamethasone sodium phosphate), diflorasones (e.g., diflorasone diacetate), diflucortolones, difluprednates, enoxolones, fluazacorts, flucloronides, fludrocortisones (e.g., fludrocortisone acetate), flumethasones (e.g., flumethasone pivalate), flunisolides, fluocinolones (e.g., fluocinolone acetonide), fluocinonides, fluocortins, fluocortolones, fluorometholones (e.g., fluorometholone acetate), fluperolones (e.g., fluperolone acetate), fluprednidenes, fluprednisolones, flurandrenolides, fluticasones (e.g., fluticasone propionate), formocortals, halcinonides, halobetasols, halometasones, halopredones, hydrocortamates, hydrocortisones (e.g., hydrocortisone 21-butyrate, hydrocortisone aceponate, hydrocortisone acetate, hydrocortisone buteprate, hydrocortisone butyrate, hydrocortisone cypionate, hydrocortisone hemisuccinate, hydrocortisone probutate, hydrocortisone sodium phosphate, hydrocortisone sodium succinate, hydrocortisone valerate), loteprednol etabonate, mazipredones, medrysones, meprednisones, methylprednisolones (methylprednisolone aceponate, methylprednisolone acetate, methylprednisolone hemi succinate, methylprednisolone sodium succinate), mometasones (e.g., mometasone furoate), paramethasones (e.g., paramethasone acetate), prednicarbates, prednisolones (e.g., prednisolone 25-diethylaminoacetate, prednisolone sodium phosphate, prednisolone 21-hemisuccinate, prednisolone acetate; prednisolone farnesylate, prednisolone hemisuccinate, prednisolone-21 (beta-D-glucuronide), prednisolone metasulphobenzoate, prednisolone steaglate, prednisolone tebutate, prednisolone tetrahydrophthalate), prednisones, prednivals, prednylidenes, rimexolones, tixocortols, triamcinolones (e.g., triamcinolone acetonide, triamcinolone benetonide, triamcinolone hexacetonide, triamcinolone acetonide 21-palmitate, triamcinolone diacetate). These glucocorticoids and the salts thereof are discussed in detail, for example, in Remington's Pharmaceutical Sciences, A. Osol, ed., Mack Pub. Co., Easton, Pa. (16th ed. 1980).

In some examples, the glucocorticoid is selected from among cortisones, dexamethasones, hydrocortisones, methylprednisolones, prednisolones and prednisones. In a particular example, the glucocorticoid is dexamethasone.

The corticosteroid is provided in a therapeutically effective dose. Therapeutically effective concentration can be determined empirically by testing in known in vitro or in vivo (e.g., animal model) systems. For example, the amount of a selected corticosteroid to be administered to ameliorate the adverse effects can be determined by standard clinical techniques. In addition, animal models can be employed to help identify optimal dosage ranges. The precise dosage, which can be determined empirically, can depend on the particular therapeutic preparation, the regimen and dosing schedule, the route of administration and the seriousness of the disease.

The concentration of a selected therapeutic agent in the composition depends on absorption, inactivation and excretion rates, the physicochemical characteristics, the dosage schedule, and amount administered as well as other factors known to those of skill in the art. For example, it is understood that the precise dosage and duration of treatment is a function of the disease or condition, the tissue being treated, the patient or subject and the anti-hyaluronan agent, including amount and dosage regimen. The dose of the corticosteroid also can vary depending on the age and health of the patient, the polymer-conjugated hyaluronan-degrading enzyme dosing (e.g., PEGylated hyaluronan-degrading enzyme dosing), potency of the corticosteroid, and the route of administration. For example, it is to be noted that concentrations and dosage values will vary with the therapeutic dose and dosage regimen of the hyaluronan-degrading enzyme. Additionally, the corticosteroid can be administered daily, weekly, or monthly or over longer periods of time in order to achieve the desired results. The particular dosage volume can vary and is dependent on the dosage regimen, frequency of administration and the desired rate of administration. It is to be noted that concentrations and dosage values can also vary with the age of the individual treated.

The precise dosage and duration of treatment can be determined empirically using known testing protocols or by extrapolation from in vivo or in vitro test data. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof. Generally, dosage regimens are chosen to limit toxicity, and herein are chosen to ameliorate adverse side effects. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects). Administration of a therapeutic agent should not exceed the maximum dosage levels established by the United States Food and Drug Administration or published in the Physician's Desk Reference.

Generally, the dose of corticosteroid administered is dependent upon the specific corticosteroid, as a difference in potency exists between different corticosteroids (see Table 10 below). The corticosteroid, or glucocorticoid, for example dexamethasone, can be given orally (tablets, liquid or liquid concentrate) PO, intravenously (IV) or intramuscularly. The corticosteroid is typically administered as a bolus, but many be administered over a period of time, as long as the dose is effective to ameliorate one or more side effects associated with administration of the anti-hyaluronan agent, for example, a PEGylated hyaluronidase.

TABLE 10

Glucocorticoid administration

| Glucocorticoid (route) | Equivalent Potency (mg) |
|---|---|
| Hydrocortisone (IV or PO) | 20 |
| Prednisone | 5 |
| Prednisolone (IV or PO) | 5 |
| Methylprednisolone sodium succinate (IV) | 4 |
| Dexamethasone (IV or PO) | 0.5-0.75 |

The corticosteroid can be administered in any amount that is effective to ameliorate one or more side effects associated with administration of the hyaluronan-degrading enzyme. Thus, the corticosteroid, e.g., glucocorticoid, can be administered, for example, at an amount between at or about 0.1 and 100 mgs, per dose, 0.1 to 80 mgs, 0.1 to 60 mgs, 0.1 to 40 mgs, 0.1 to 30 mgs, 0.1 to 20 mgs, 0.1 to 15 mgs, 0.1 to 10 mgs, 0.1 to 5 mgs, 0.2 to 40 mgs, 0.2 to 30 mgs, 0.2 to 20 mgs, 0.2 to 15 mgs, 0.2 to 10 mgs, 0.2 to 5 mgs, 0.4 to 40 mgs, 0.4 to 30 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs, to a 70 kg adult human subject. Typically, the corticosteroid, such as a glucocorticoid is administered at an amount between at or about 0.4 and 20 mgs, for example, at or about 0.4 mgs, 0.5 mgs, 0.6 mgs, 0.7 mgs, 0.75 mgs, 0.8 mgs, 0.9 mgs, 1 mg, 2 mgs, 3 mgs, 4 mgs, 5 mgs, 6 mgs, 7 mgs, 8 mgs, 9 mgs, 10 mgs, 11 mgs, 12 mgs, 13 mgs, 14 mgs, 15 mgs, 16 mgs, 17 mgs, 18 mgs, 19 mgs or 20 mgs per dose, to an average adult human subject.

The corticosteroid can be administered, for example, at a dosage of at or about 0.001 mg/kg (of the subject), 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.015 mg/kg, 0.02 mg/kg, 0.025 mg/kg, 0.03 mg/kg, 0.035 mg/kg, 0.04 mg/kg, 0.045 mg/kg, 0.05 mg/kg, 0.055 mg/kg, 0.06 mg/kg, 0.065 mg/kg, 0.07 mg/kg, 0.075 mg/kg, 0.08 mg/kg, 0.085 mg/kg, 0.09 mg/kg, 0.095 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.50 mg/kg, 0.55 mg/kg, 0.60 mg/kg, 0.65 mg/kg, 0.70 mg/kg, 0.75 mg/kg, 0.80 mg/kg, 0.85 mg/kg, 0.90 mg/kg, 0.95 mg/kg, 1 mg/kg, 1.05 mg/kg, 1.1 mg/kg, 1.15 mg/kg, 1.20 mg/kg, 1.25 mg/kg, 1.3 mg/kg, 1.35 mg/kg or 1.4 mg/kg, to an average adult human subject, typically weighing about 70 kg to 75 kg.

The dosage administered can vary as long as administration of the corticosteroid ameliorates one or more adverse side effects associated with administration of the hyaluronan-degrading enzyme. In one example, the dosage of glucocorticoid, for example, dexamethasone, is administered in successively lower dosages per treatment cycle. Hence, in such treatment regimes, the dose of corticosteroid is tapered. For example, dexamethasone is administered prior to administration of an hyaluronan-degrading enzyme, at an initial dose of 4 mg, and upon each successive administration of the hyaluronan-degrading enzyme, the dexamethasone dose is lowered, such that the dose is 3 mg for the next administration of the hyaluronan-degrading enzyme, e.g., PEGylated hyaluronidase, then 2 mg per administration of anti-hyaluronan agent, e.g., PEGylated hyaluronidase, and then 1 mg per administration of anti-hyaluronan agent, e.g., PEGylated hyaluronidase. Any dose is contemplated as long as the dose of the corticosteroid is effective to reduce one or more side effects associated with administration of the hyaluronan-degrading enzyme, e.g., a PEGylated hyaluronidase.

Time of administration can vary as long as administration of the corticosteroid ameliorates one or more adverse side effects associated with administration of the hyaluronan-degrading enzyme, such as a PEGylated hyaluronidase. The corticosteroid can be administered sequentially, intermittently, at the same time or in the same composition as hyaluronan-degrading enzyme, e.g., PEGylated hyaluronan-degrading enzyme. For example, the corticosteroid can be administered before, during, simultaneously with, or after administration of the hyaluronan-degrading enzyme, e.g., PEGylated hyaluronidase. In another example, the corticosteroid and hyaluronan-degrading enzyme, e.g., PEGylated hyaluronidase are administered intermittently. Generally, the corticosteroid is administered prior to administration of the hyaluronan-degrading enzyme, e.g., PEGylated hyaluronidase. For example, the corticosteroid, e.g., glucocorticoid, such as dexamethasone, can be administered at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more prior to administration of the anti-hyaluronan agent, for example a PEGylated hyaluronan-degrading enzyme.

In some examples, the corticosteroid is administered at the same time as administration of the hyaluronan-degrading enzyme, for example a PEGylated hyaluronan-degrading enzyme. In this example, the corticosteroid can be administered together with, or separately from, the hyaluronan-degrading enzyme, e.g., a PEGylated hyaluronidase. Typically, the corticosteroid is administered separately from the hyaluronan-degrading enzyme, for example a PEGylated hyaluronan-degrading enzyme. In other examples, the corticosteroid is administered at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more after administration of the hyaluronan-degrading enzyme, for example a PEGylated hyaluronan-degrading enzyme.

In one example, the corticosteroid is administered prior to administration of hyaluronan-degrading enzyme, for example a PEGylated hyaluronidase. For example, the corticosteroid, e.g., glucocorticoid, for example, dexamethasone, is administered 1 hour prior to the administration of the hyaluronan-degrading enzyme, e.g., a PEGylated hyaluronidase. In another example, the corticosteroid is administered 5 minutes before the administration of the hyaluronan-degrading enzyme, e.g., a PEGylated hyaluronan-degrading enzyme. In another example, the corticosteroid is administered both prior to and after the administration of hyaluronan-degrading enzyme, e.g., a PEGylated hyaluronidase. In this example, the corticosteroid, such as dexamethasone, is administered one to five minutes immediately before administration of the hyaluronan-degrading enzyme, e.g., a PEGylated hyaluronan-degrading enzyme and eight hours after administration of the anti-hyaluronan agent, e.g., a PEGylated hyaluronan-degrading enzyme. In another example, a corticosteroid, such as dexamethasone, is administered one hour before administration of the hyaluronan-degrading enzyme, e.g., a PEGylated hyaluronan-degrading enzyme and eight to twelve hours after administration of the anti-hyaluronan agent, e.g., a PEGylated hyaluronan-degrading enzyme.

Any dosing regimen is contemplated as long as the time of dosing of the corticosteroid ameliorates the one or more side effects associated with administration of the hyaluronan-degrading enzyme, for example a PEGylated hyaluronidase. In addition, the dose or dosing regimen of corticosteroid is one that does not interfere or reduce the therapeutic effect of the hyaluronan-degrading enzyme or other agent in the compositions and combinations provided herein, including in treating a cancer or solid tumor.

As described and shown in the examples, administration of a corticosteroid, such as a glucocorticoid, such as dexamethasone, does not decrease the effectiveness of the checkpoint inhibitor therapy, such as the anti-CTLA4 and anti-PD-L1 antibodies, whose effectiveness is enhanced by administration with an hyaluronan-degrading enzyme, such as a hyaluronidase, such as PEGPH20, particularly if the hyaluronan-degrading enzyme, is administered about or at 8-24 hours before administration of the antibody.

b. Anti-Cancer Agents and Other Treatments

The combination therapy provided herein can be used alone or in further combination with other anti-cancer agents. The anti-cancer agent(s) or treatment(s) can be surgery, radiation, drugs, chemotherapeutics, polypeptides, antibodies, peptides, small molecules or gene therapy vectors, viruses, DNA, vaccines, tumor-associated antigens, such as dendritic cells expressing any one or more of the tumor associated antigens described herein (Section G) or known in the art.

Exemplary anti-cancer agents that can be administered after, coincident with or before administration of the combination therapy herein, include, but are not limited to Acivicins; Avicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Ciplatins; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonas; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Flurocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/ Tiuxetans; Idarubicins; Ifosfamides; Ilmofosines; Ilomastats; Imatinib mesylates; Imexons; Improsulfans; Indisulams; Inproquones; Interferon alfa-2as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprolides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patupilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofirans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars, for example:

Aldesleukins (e.g., PROLEUKIN®); Alemtuzumabs (e.g., CAMPATH®); Alitretinoins (e.g., PANRETIN®); Allopurinols (e.g., ZYLOPRIM®); Altretamines (e.g., HEXALEN®); Amifostines (e.g., ETHYOL®); Anastrozoles (e.g., ARIMIDEX®); Arsenic Trioxides (e.g., TRISENOX®); Asparaginases (e.g., ELSPAR®); BCG Live (e.g., TICE® BCG); Bexarotenes (e.g., TARGRETIN®); Bevacizumab (AVASTIN®); Bleomycins (e.g., BLENOXANE®); Busulfan intravenous (e.g., BUSULFEX®); Busulfan orals (e.g., MYLERAN®); Calusterones (e.g., METHOSARB®); Capecitabines (e.g., XELODA®); Carboplatins (e.g., PARAPLATIN®); Carmustines (e.g., BCNU®, BiCNU®); Carmustines with Polifeprosans (e.g., GLIADEL® Wafer); Celecoxibs (e.g., CELEBREX®); Chlorambucils (e.g., LEUKERAN®); Cisplatins (e.g., PLATINOL®); Cladribines (e.g., LEUSTATIN®, 2-CdA®); Cyclophosphamides (e.g., CYTOXAN®, NEOSAR®); Cytarabines (e.g., CYTOSAR-U®); Cytarabine liposomals (e.g., DepoCyt®); Dacarbazines (e.g., DTIC-Dome): Dactinomycins (e.g., COSMEGEN®); Darbepoetin Alfas (e.g., ARANESP®); Daunorubicin liposomals (e. g. DAUNOXOME®); Daunorubicins/Daunomycins (e.g., CERUBIDINE®); Denileukin Diftitoxes (e.g., ONTAK®); Dexrazoxanes (e.g., ZINECARD®); Docetaxels (e.g., TAXOTERE®); Doxorubicins (e.g., ADRIAMYCIN®, RUBEX®); Doxorubicin liposomals, including Doxorubicin HCL liposome injections (e.g., DOXIL®); Dromostanolone propionates (e.g., DROMOSTANOLONE® and MASTERONE® Injection); Elliott's B Solutions (e.g., Elliott's B Solution®); Epirubicins (e.g., ELLENCE®); Epoetin alfas (e.g., EPOGEN®); Estramustines (e.g., EMCYT®); Etoposide phosphates (e.g., ETOPOPHOS®); Etoposide VP-16s (e.g., VEPESID®); Exemestanes (e.g., AROMASIN®); Filgrastims (e.g., NEUPOGEN®); Floxuridines (e.g., FUDR®); Fludarabines (e.g., FLUDARA®); Fluorouracils incl. 5-FUs (e.g., ADRUCIL®); Fulvestrants (e.g., FASLODEX®); Gemcitabines (e.g., GEMZAR®); Gemtuzumabs/Ozogamicins (e.g., MYLOTARG®); Goserelin acetates (e.g., ZOLADEX®); Hydroxyureas (e.g., HYDREA®); Ibritumomabs/Tiuxetans (e.g., ZEVALIN®); Idarubicins (e.g., IDAMYCIN®); Ifosfamides (e.g., IFEX®); Imatinib mesylates (e.g., GLEEVEC®); Interferon alfa-2as (e.g., ROFERON-A®); Interferon alfa-2bs (e.g., INTRON A®); Irinotecans (e.g., CAMPTOSAR®); Letrozoles (e.g., FEMARA®); Leucovorins (e.g., WELLCOVORIN®, LEUCOVORIN®); Levamisoles (e.g., ERGAMISOL®); Lomustines/CCNUs (e.g., CeeBU®); Mechlorethamines/Nitrogen mustards (e.g., MUSTARGEN®); Megestrol acetates (e.g., MEGACE®); Melphalans/L-PAMs (e.g., ALKERAN®); Mercaptopurine, including 6-mercaptopurines (6-MPs; e.g., PURINETHOL®); Mesnas (e.g., MESNEX®); Methotrexates; Methoxsalens (e.g., UVADEX®); Mitomycin Cs (e.g., MUTAMYCIN®, MITOZYTREX®); Mitotanes (e.g., LYSODREN®); Mitoxantrones (e.g., NOVANTRONE®); Nandrolone Phenpropionates (e.g., DURABOLIN-50®); Nofetumomabs (e.g., VERLUMA®); Oprelvekins (e.g., NEUMEGA®); Oxaliplatins (e.g., ELOXATIN®); Paclitaxels (e.g., PAXENE®, TAXOL®); Pamidronates (e.g., AREDIA®); Pegademases (e.g., ADAGEN®); Pegaspargases (e.g., ONCASPAR®); Pegfilgrastims (e.g., NEULASTA®); Pentostatins (e.g., NIPENT®); Pipobromans (e.g., VERCYTE®); Plicamycin/Mithramycins (e.g., MITHRACIN®); Porfimer sodiums (e.g., PHOTOFRIN®); Procarbazines (e.g., MATULANE®); Quinacrines (e.g., ATABRINE®); Rasburicases (e.g., ELITEK®); Rituximabs (e.g., RITUXAN®); Sargramostims (e.g., PROKINE®); Streptozocins (e.g., ZANOSAR®); Sunitinib Malates (e.g., SUTENT®); Talcs (e.g., SCLEROSOL®); Tamoxifens (e.g., NOLVADEX®); Temozolomides (e.g., TEMODAR®); Teniposides/VM-26s (e.g., VUMONg); Testolactones (e.g., TESLAC®); Thioguanines including, 6-thioguanine (6-TG); Thiotepas (e.g., THIOPLEX®); Topotecans (e.g., HYCAMTIN®); Toremifenes (e.g., FARESTON®); Tositumomabs (e.g., BEXXAR®); Trastuzumabs (e.g., HERCEPTIN®); Tretinoins/ATRA (e.g., VESANOID®); Uracil Mustards; Valrubicins (e.g., VALSTAR®); Vinblastines (e.g., VELBAN®); Vincristines (e.g., ONCOVIN®); Vinorelbines (e.g., NAVELBINE®); and Zoledronates (e.g., ZOMETA®).

H. Examples

The following examples are included for illustrative purposes only and are not intended to limit the scope of the invention.

Example 1

Generating a Hyaluronan (HA)-High Syngeneic Tumor Mouse Model

A. Generating Hyaluronan (HA)-High Syngeneic Colon Tumor Mouse Model

1. Generating Hyaluronan (HA)-High CT26/HAS3 Cell Line

CT26 Balb/c mouse colon carcinoma cells (ATCC, cat #CRL-2638) were engineered to constitutively express human hyaluronan synthase 3 (HAS3). A lentivirus vector, designated pLV-EF1a-hHAS3-IRES-Hyg (SEQ ID NO: 1), was generated by inserting HAS3 cDNA (SEQ ID NO: 2) between the XbaI and MluI restriction sites within the multiple cloning site of pLV-EF1a-MCS-IRES-Hyg (Bio-Settia, Inc.; SEQ ID NO: 3). CT26 cells were infected with the resultant pLV-EF1a-hHAS3-IRES-Hyg vector (SEQ ID NO: 1), and stably transduced cells, designated CT26/HAS3 cells, were selected by hygromycin treatment. CT26/HAS3 cells were maintained in tissue culture as an adherent monolayer in RPMI 1640 medium supplemented with 2 mM L-glutamine and 10% fetal bovine serum at 37° C. and 5% $CO_2$.

2. Generating Syngeneic CT26/HAS3 Tumor Model

CT26/HAS3 or CT26 parental cells as described in part 1 above were trypsin-harvested at 80-90% confluency, washed twice with sterile Hanks Balanced Salt Solution (HBSS), and diluted with HBSS to a concentration of $4 \times 10^6$ cells/mL. Male Balb/c mice were obtained at 4-6 weeks from Taconic Farms and housed 4/cage. For tumor inoculations, mice were injected with 50 µL of cell suspension ($2 \times 10^5$ cells total) intramuscularly, adjacent to the right tibial periosteum.

Tumor volumes were measured by ultrasound using VisualSonics Vevo 2100 ultrasound (Toronto, Canada) and Vevo 2100 v1.5.0 imaging software. Animals were anesthetized using light isoflurane anesthesia while the tumor volumes were measured. For tumor measurement, the region of interest was covered in ultrasound gel (Parker Laboratories, Fairfield, N.J.), and the RMV-716 (focal depth=17.5 mm) scan head was positioned directly over the region of interest. While in 2D-Mode, the approximate center of the tumor was located, and subsequently an image (~150-200 frames) was captured using 3D-mode. Approximately 15-30 frames out of 150-200 frames were analyzed and a tumor volume calculated and expressed in $mm^3$.

3. Measurement of HA Levels in Tumor Tissue

At the conclusion of tumor growth experiments, tumors were excised and portions stored frozen at ≤−60° C. To obtain extracts for HA quantitation, tumor tissue was digested 24 h at 55° C. on a tube rocker using 40 µL per mg tissue of a solution containing proteinase K (Sigma, Cat. No. P4850) at 1 mg/mL in 50 mM Tris-HCl pH 8.0, 10 mM $MgCl_2$, and 2 mM $CaCl_2$. The proteinase K was then heat-inactivated at 100° C. for 30 min, the resulting solution was centrifuged at 10,000 g for 20 min at 4-10° C., and the supernatant used for HA quantitation by Hyaluronan Duo Set ELISA (R&D Systems, Cat. No. DY3614) according to the manufacturer's instructions. The standard curve was obtained using a three-fold dilution series of six total dilutions starting at 90 ng/mL, and all samples were diluted such that their resulting concentrations fell within the range of 0.37-20 ng/mL. Using this procedure, tumors grown from low-HA CT26 parental cells contained 73±8 ng HA/mg tissue, whereas tumors grown from high-HA CT26/HAS3 cells contained 1087±126 ng HA/mg tissue.

B. Generating a Hyaluronan (HA)-High Syngeneic Pancreatic Tumor Mouse Model

1. Generating Hyaluronan (HA)-High MH194/HAS3 Cell Line

MH194 mouse pancreatic carcinoma cells (derived from the KrasLSL.G12D/+p53R172H/+PdxCretg/+ genetically engineered mouse model) were engineered to constitutively express human hyaluronan synthase 3 (HAS3) as in Example 1A. Stably transduced cells, designated MH194/HAS3 cells, were selected by hygromycin treatment. MH194/HAS3 and parental MH194 cells were maintained in tissue culture as an adherent monolayer in DMEM medium supplemented with 2 mM L-glutamine and 10% fetal bovine serum at 37° C. and 5% $CO_2$.

2. Pancreatic Stellate Cell Isolation and Immortalization

Pancreas from C57BL/6 mice were minced with razor blades and placed in 2 mL of a digestion buffer containing 0.05% collagenase P, 0.1% DNAse, and 0.02% Pronase in Gey's balanced salt solution (GBSS). Following two 15 mM digestion incubations at 37° C. with thorough mixing after each incubation, the resulting cell suspension was filtered through a 100 µm nylon mesh, washed twice in GBSS with 0.3% bovine serum albumin (BSA), and resuspended in 10 mL GBSS/BSA. Eight mL of Histodenz (Sigma, Cat. No. D2158) was added to the cell suspension, and the entire volume was pipetted under 6 mL GBSS/BSA in order to generate a discontinuous density gradient. Following centrifugation for 20 min at 1,400 g with the brake set at zero, the desired cells were harvested from the interface between the two density volumes and washed once with PBS and once with DMEM medium supplemented with 2 mM L-glutamine, 10% fetal bovine serum, and 1% amphotericin-B (complete DMEM). Cells were immortalized using Lenti-SV40 (Capital Biosciences, Cat. No. CIP-0011) using manufacturer's protocol. The resulting cell line, designated PSC4, were maintained in tissue culture as an adherent monolayer in complete DMEM at 37° C. and 5% $CO_2$.

3. Generating Syngeneic MH194/HAS3 Tumor Model

MH194/HAS3 cells as described in part A above were trypsin-harvested at 80-90% confluency, washed twice with sterile Hanks Balanced Salt Solution (HBSS), and diluted with HBSS to a concentration of $4 \times 10^6$ cells/mL. Male C57BL/6 mice were obtained at 4-6 weeks from Taconic Farms and housed 4/cage. For tumor inoculations, mice were injected with 50 µL of cell suspension containing $2 \times 10^5$ MH194/HAS3 cells or parental MH194 cells along with $5 \times 10^5$ PSC4 ($7 \times 10^5$ cells total) intramuscularly, adjacent to the right tibial periosteum.

Tumor volumes were measured by ultrasound as in Example 1A2. Approximately 15-30 frames out of 150-200 frames were analyzed and a tumor volume calculated and expressed in $mm^3$. When using the HA quantitation procedure described in Example 1A3, tumors grown from parental MH194+PSC4 cells contained 263±16 ng HA/mg tissue, whereas tumors grown from MH194/HAS3+PSC4 cells contained 1783±99 ng HA/mg tissue.

Example 2

Generating HA-High Human Xenograft Tumor Mouse Model

A. Generating Hyaluronan (HA)-High SKOV3/HAS2 Cell Line

SKOV3 human ovarian cancer cells (ATCC, cat #HTB-77) were engineered to constitutively express human hyaluronan synthase 2 (HAS2). HAS2 cDNA (SEQ ID NO: 317) was inserted between the XbaI and MluI restriction sites within the multiple cloning site of the lentivirus vector pLV-EF1a-MCS-IRES-Hyg (BioSettia, Inc.; SEQ ID NO: 3) to generate pLV-EF1a-hHAS2-IRES-Hyg vector. SKOV3 cells were infected with the resultant vector. Stably transduced cells, designated SKOV3/HAS2 cells, were selected by Hygromycin treatment. SKOV3/HAS2 cells were maintained in tissue culture as an adherent monolayer in McCoy's 5A medium supplemented with 2 mM L-glutamine and 10% fetal bovine serum at 37° C. and 5% $CO_2$.

B. SKOV3/HAS2 Xenograft Tumor Mouse Model

SKOV3/HAS2 cells, described in part A above, were trypsin-harvested at 80-90% confluency, washed twice with sterile Hanks Balanced Salt Solution (HBSS), and diluted with HBSS to a concentration of $100 \times 10^6$ cells/mL. Female nude mice (nu/nu) were obtained at 4-6 weeks from Taconic Farms and housed 4/cage. For tumor inoculations, mice were injected with 50 µL of cell suspension ($5 \times 10^6$ cells total) intramuscularly, adjacent to the right tibial periosteum. Tumor volumes were measured as described in Example 1B above.

Using the HA quantitation procedure described in Example 1A3, tumors grown from SKOV3/HAS2 cells contained 2343±199 ng HA/mg tissue.

Example 3

Production and Purification of Recombinant Human PH20 (rHuPH20)

A. Generation of an Initial Soluble rHuPH20-Expressing Cell Line

Chinese Hamster Ovary (CHO) cells were transfected with the HZ24 plasmid (set forth in SEQ ID NO: 4). The HZ24 plasmid vector for expression of soluble rHuPH20 contains a pCI vector backbone (Promega), DNA encoding amino acids 1-482 of human PH20 hyaluronidase (SEQ ID NO: 5), an internal ribosomal entry site (IRES) from the ECMV virus (Clontech), and the mouse dihydrofolate reductase (DHFR) gene. The pCI vector backbone also includes the ampicillin resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO: 6), followed by a BamHI restriction site. The construct pCI-PH20-IRES-DHFR-SV40pa (HZ24), therefore, results in a single mRNA species driven by the CMV promoter that encodes amino acids 1-482 of human PH20 (set forth in SEQ ID NO: 7) and amino acids 1-186 of mouse dihydrofolate reductase (set forth in SEQ ID NO: 8) separated by the internal ribosomal entry site (IRES).

Non-transfected CHO cells growing in GIBCO Modified CD-CHO media for DHFR(−) cells, supplemented with 4 mM Glutamine and 18 mL/L Pluronic F68/L (Gibco), were seeded at $0.5 \times 10^6$ cells/mL in a shaker flask in preparation for transfection. Cells were grown at 37° C. in 5% $CO_2$ in a humidified incubator, shaking at 120 rpm. Exponentially growing non-transfected CHO cells were tested for viability prior to transfection.

Sixty million viable cells of the non-transfected CHO cell culture were pelleted and resuspended to a density of $2 \times 10^7$ cells in 0.7 mL of 2× transfection buffer (2×HeBS: 40 mM HEPES, pH 7.0, 274 mM NaCl, 10 mM KCl, 1.4 mM $Na_2HPO_4$, 12 mM dextrose). To each aliquot of resuspended cells, 0.09 mL (250 μg) of the linear HZ24 plasmid (linearized by overnight digestion with ClaI (New England Biolabs)) were added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 μF or at 350 V and 960 μF.

The cells were removed from the cuvettes after electroporation and transferred into 5 mL of Modified CD-CHO media for DHFR(−) cells, supplemented with 4 mM Glutamine and 18 mL/L Pluronic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media were removed from each well and tested for the presence of hyaluronidase activity using the microturbidity assay described in Example 4. Cells expressing the highest levels of hyaluronidase activity were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume: 0.2 mL).

Ten clones were identified from the 5 plates grown without methotrexate. Six of these HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment). Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate in shaker flasks and gave rise to clones producing in excess of 1,000 Units/mL hyaluronidase activity (clone 3D35M; or Gen1 3D35M). A master cell bank (MCB) of the 3D35M cells was then prepared.

B. Generation of a Second Generation Cell Line Expressing Soluble rHuPH20

The Gen1 3D35M cell line, described in part A above, was adapted to higher methotrexate levels to produce generation 2 (Gen2) clones. 3D35M cells were seeded from established methotrexate-containing cultures into CD CHO medium containing 4 mM GlutaMAX-1™ and 1.0 μM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 μM methotrexate. After approximately 4 weeks, clones were identified and clone 3E10B was selected for expansion. 3E10B cells were grown in CD CHO medium containing 4 mM GlutaMAX-1™ and 2.0 μM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 μM methotrexate. After the $12^{th}$ passage, cells were frozen in vials as a research cell bank (RCB). One vial of the RCB was thawed and cultured in medium containing 8.0 μM methotrexate. After 5 days, the methotrexate concentration in the medium was increased to 16.0 then increased to 20.0 μM 18 days later. Cells from the $8^{th}$ passage in medium containing 20.0 μM methotrexate were cloned out by limiting dilution in 96-well tissue culture plates containing CD CHO medium containing 4 mM GlutaMAX-1™ and 20.0 μM methotrexate. Clones were identified 5-6 weeks later and clone 2B2 was selected for expansion in medium containing 20.0 μM methotrexate. After the 11th passage, 2B2 cells were frozen in vials as a research cell bank (RCB).

The resultant 2B2 cells are dihydrofolate reductase deficient (dhfr-) DG44 CHO cells that express soluble recombinant human PH20 (rHuPH20). The soluble PH20 is present in 2B2 cells at a copy number of approximately 206 copies/cell. Southern blot analysis of SpeI-, XbaI- and BamHI/HindIII-digested genomic 2B2 cell DNA using a rHuPH20-specific probe revealed the following restriction digest profile: one major hybridizing band of ~7.7 kb and four minor hybridizing bands (~13.9, ~6.6, 5.7 and ~4.6 kb) with DNA digested with SpeI; one major hybridizing band of ~5.0 kb and two minor hybridizing bands (~13.9 and ~6.5 kb) with DNA digested with XbaI; and one single hybridizing band of ~1.4 kb observed using 2B2 DNA digested with BamHI/HindIII. Sequence analysis of the mRNA transcript indicated that the derived cDNA (SEQ ID NO: 9) was identical to the reference sequence (SEQ ID NO: 5) except for one base pair difference at position 1131, which was observed to be a thymidine (T) instead of the expected cytosine (C). This is a silent mutation, with no effect on the amino acid sequence.

C. Production of Gen2 Soluble rHuPH20 in 300 L Bioreactor Cell Culture

A vial of HZ24-2B2 cells (described in part B above) was thawed and expanded from shaker flasks through 36 L spinner flasks in CD-CHO media (Invitrogen, Carlsbad, Calif.) supplemented with 20 μM methotrexate and GlutaMAX-1™ (Invitrogen). Briefly, a vial of cells was thawed in a 37° C. water bath, medium was added and the cells were centrifuged. The cells were re-suspended in a 125 mL shake flask with 20 mL of fresh media and placed in a 37° C., 7% $CO_2$ incubator. The volume was increased to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5 \times 10^6$ cells/mL, the culture was expanded into a 250 mL spinner flask in 200 mL culture volume, and the flask was incubated at 37° C., 7% $CO_2$. When the cell density reached greater than $1.5 \times 10^6$ cells/mL, the culture was expanded into a 1 L spinner flask in 800 mL culture volume and incubated at 37° C., 7% $CO_2$. When the cell density reached greater than $1.5 \times 10^6$ cells/mL the culture was expanded into a 6 L spinner flask in 5000 mL culture volume and incubated at 37° C., 7% $CO_2$. When the cell density reached greater than $1.5 \times 10^6$ cells/mL the culture was expanded into a 36 L spinner flask in 32 L culture volume and incubated at 37° C., 7% $CO_2$.

A 400 L reactor was sterilized and 230 mL of CD-CHO media were added. Before use, the reactor was checked for contamination. Approximately 30 L cells were transferred from the 36 L spinner flasks to the 400 L bioreactor (Braun) at an inoculation density of $4.0 \times 10^5$ viable cells per mL and a total volume of 260 L. Parameters were temperature set point, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run, nutrient feeds were added. At 120 hrs (day 5), 10.4 L of Feed #1 Medium (4×CD-CHO+33 g/L glucose+160 mL/L GlutaMAX-1™+83 mL/L Yeastolate+33 mg/L rHu insulin) were added. At 168 hours (day 7), 10.8 L of Feed #2 (2×CD-CHO+33 g/L glucose+80 mL/L GlutaMAX-1™+167 mL/L Yeastolate+0.92 g/L sodium butyrate) were added, and culture temperature was reduced to 36.5° C. At 216 hours (day 9), 10.8 L of Feed #3 (1×CD-CHO+50 g/L glucose+50 mL/L GlutaMAX-1™+250 mL/L Yeastolate+1.80 g/L sodium butyrate) were added, and culture temperature was reduced to 36° C. At 264 hours (day 11), 10.8 L of Feed #4 (1× CD-CHO+33 g/L glucose+33 mL/L GlutaMAX-1™+250 mL/L Yeastolate+0.92 g/L sodium butyrate) were added, and the culture temperature was reduced to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per mL with a maximal cell density of 12 million cells/mL. At harvest, the culture was sampled for mycoplasma, bioburden, endotoxin and virus in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 μm and a layer of diatomaceous earth graded to 1.4-1.1 μm, followed by a cellulose membrane, then through a second single Millistak filtration system (Millipore) containing a layer of diatomaceous earth graded to 0.4-0.11 μm and a layer of diatomaceous earth graded to <0.1 μm, followed by a cellulose membrane, and then through a 0.22 μm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four 30 kDa molecular weight cut-off (MWCO) polyether sulfone (PES) filters (Sartorius), followed by a 10× buffer exchange with 10 mM Tris, 20 mM $Na_2SO_4$, pH 7.5 into a 0.22 μm final filter into a 50 L sterile storage bag.

The concentrated, diafiltered harvest was inactivated for virus. Prior to viral inactivation, a solution of 10% Triton X-100, 3% tri (n-butyl) phosphate (TNBP) was prepared. The concentrated, diafiltered harvest was exposed to 1% Triton X-100, 0.3% TNBP for 1 hour in a 36 L glass reaction vessel immediately prior to purification on the Q column.

D. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM $Na_2SO_4$, pH 7.5. Following viral inactivation, the concentrated, diafiltered harvest (described in part C above) was loaded onto the Q column at a flow rate of 100 cm/hr. The column was washed with 5 column volumes of 10 mM Tris, 20 mM $Na_2SO_4$, pH 7.5 and 10 mM HEPES, 50 mM NaCl, pH 7.0. The protein was eluted with 10 mM HEPES, 400 mM NaCl, pH 7.0 into a 0.22 μm final filter into sterile bag. The eluate sample was tested for bioburden, protein concentration and hyaluronidase activity. $A_{280}$ absorbance readings were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM $CaCl_2$, pH 7.0. The protein eluate from the Q sepharose column was supplemented with 2 M ammonium sulfate, 1 M potassium phosphate and 1 M $CaCl_2$ stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM $CaCl_2$ pH 7.0 at 100 cm/hr and the wash was added to the collected flow thru. Combined with the column wash, the flow through was passed through a 0.22 μm final filter into a sterile bag. The flow through was sampled for bioburden, protein concentration and enzyme activity.

An aminophenyl boronate column (ProMedics) was prepared. The wash was collected and sampled for pH, conductivity and endotoxin (LAL) assay. The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM HEPES, 100 mM NaCl, pH 6.9 and passed through a sterile filter into a sterile bag. The eluted sample was tested for bioburden, protein concentration and enzyme activity.

The hydroxyapatite (HAP) column (Bio-Rad) was prepared. The wash was collected and tested for pH, conductivity and endotoxin (LAL assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM CaCl$_2$. The protein was eluted with 70 mM potassium phosphate, pH 7.0 and passed through a 0.22 μm sterile filter into a sterile bag. The eluted sample was tested for bioburden, protein concentration and enzyme activity.

The HAP purified protein was then passed through a viral removal filter. The sterilized Virosart® filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 μm final filter into a sterile bag. The viral filtered sample was tested for protein concentration, enzyme activity, oligosaccharide, monosaccharide and sialic acid profiling. The sample also was tested for process related impurities.

Example 4

Determination of Hyaluronidase Activity of Soluble rHuPH20

Hyaluronidase activity of soluble rHuPH20 in samples such as cell cultures, plasma, purification fractions and purified solutions was determined using either a turbidimetric assay, which is based on the formation of an insoluble precipitate when hyaluronic acid binds with serum albumin, or a biotinylated-hyaluronic acid substrate assay, which measures the amount of enzymatically active rHuPH20 or PEGPH20 by the digestion of biotinylated hyaluronic acid (b-HA) substrate non-covalently bound to plastic multi-well microtiter plates.

A. Microturbidity Assay

Hyaluronidase activity of soluble rHuPH20 is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30-minute development period. The decrease in turbidity resulting from enzyme activity on the sodium hyaluronate substrate is a measure of the soluble rHuPH20 hyaluronidase activity. The method is performed using a calibration curve generated with dilutions of a soluble rHuPH20 assay working reference standard, and sample activity measurements are made relative to this calibration curve.

Dilutions of the sample were prepared in Enzyme Diluent Solutions. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of sterile water for injection (SWFI), and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not less than 20 μL. The minimum sample volumes needed to perform the assay were as follows: In-process Samples, FPLC Fractions: 80 μL; Tissue Culture Supernatants: 1 mL; Concentrated Material: 80 μL; Purified or Final Step Material: 80 μL. The dilutions were made in triplicate in a Low Protein Binding 96-well plate, and 30 μL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 μL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 μL sodium hyaluronate into each well. The plate was then removed from the MULTIDROP 384 and shaken for 10 seconds before being transferred to a heat block with the plate cover replaced. The plate was incubated at 37° C. for 10 minutes.

The MULTIDROP 384 was prepared to stop the reaction by priming the machine with Serum Working Solution and changing the volume setting to 240 μL (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384, and 240 μL of serum Working Solution was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/mL) by the protein concentration (mg/mL).

B. Biotinylated Hyaluronan Assay

The biotinylated-hyaluronic acid assay measures the amount of enzymatically active rHuPH20 or PEGPH20 in biological samples by the digestion of a large molecular weight (~1.2 megadaltons) biotinylated hyaluronic acid (b-HA) substrate non-covalently bound to plastic multi-well microtiter plates. The rHuPH20 or PEGPH20 in standards and samples are allowed to incubate in a plate coated with b-HA at 37° C. After a series of washes, remaining uncleaved/bound b-HA is treated with Streptavidin Horseradish Peroxidase conjugate (SA-HRP). Reaction between immobilized SA-HRP and the chromogenic substrate, 3,3', 5,5'-tetramethylbenzidine (TMB), produces a blue colored solution. After stopping the reaction with acid, formation of the soluble yellow reaction product is determined by reading the absorbance at 450 nm using a microtiter plate spectrophotometer. The decrease in absorbance at 450 nm resulting from enzyme activity on the biotinylated hyaluronic acid (b-HA) substrate is a measure of the soluble rHuPH20 hyaluronidase activity. The method is performed using a calibration curve generated with dilutions of a soluble rHuPH20 or PEGPH20 reference standard, and sample activity measurements are made relative to this calibration curve.

Dilutions of the sample and calibrator were prepared in Assay Diluent. The Assay Diluent was prepared by adding 1% v/v pooled plasma (from the appropriate species) to 0.1% (w/v) BSA in HEPES, pH 7.4. This was prepared daily and stored at 2-8° C. Depending upon the species type as well as the anticipated hyaluronidase level, single or multiple dilutions were prepared to ensure at least one sample dilution would fall within the range of the calibration curve. To guide the selection of test sample dilution(s), information known about the dose of hyaluronidase administered, the route of administration, approximate plasma volume of the species and the time point were used to estimate the hyaluronidase activity levels. Each sample dilution was mixed as it was prepared by brief pulse-vortexing and pipet tips were changed in between each dilution. In general, the dilutions began with an initial 50 or 100-fold dilution followed by additional serial dilutions. A seven-point calibration curve of rHuPH20 or PEGPH20 (depending upon the treatment administered) was prepared ranging in concentration from 0.004 to 3.0 U/mL for rHuPH20 and from 0.037 to 27 U/mL for PEGPH20. One-hundred microliters (100 μL) of each test sample dilution and calibration curve point was applied to triplicate wells of a 96-well microtiter plate (Immulon 4HBX, Thermo) that had been previously coated with 100 μL per well of b-HA at 0.1 mg/mL and blocked with 250 μL of 1.0% (w/v) bovine serum albumin in PBS. Plate(s) were covered with an adhesive plate seal and incubated at 37° C. for approximately 90 minutes. At the end of the incubation period, the adhesive seal was removed from the plate, samples were aspirated and the plate washed five (5) times with 300 μL per well Wash Buffer (10 mM phosphate buffer, 2.7 mM potassium chloride, 137 mM sodium chloride, pH 7.4, with 0.05% (v/v) Tween 20, PBST) using an automated plate washer (BioTek ELx405 Select CW, Program '4HBX1'). One hundred microliters of Streptavidin-HRP Conjugate Working Solution [Streptavidin-HRP conjugate (1:5,000 v/v) in 20 mM Tris-HCl, 137 mM sodium chloride, 0.025% (v/v) Tween 20, 0.1% (w/v) bovine serum albumin] was added per well. The plate was sealed and allowed to incubate at ambient temperature for approximately 60 minutes without shaking and protected from light. At the end of the incubation period, the adhesive seal was removed from the plate, samples were aspirated and the plate washed five (5) times with 300 μL per well Wash Buffer as described above. TMB solution (at ambient temperature) was added to each well and allowed to incubate protected from light for approximately five (5) minutes at room temperature. TMB Stop Solution (KPL, Catalog #50-85-06) was then added as 100 μL per well. The absorbance of each well at 450 nm was determined using a microtiter plate spectrophotometer. The response of the Calibration Curve on each plate was modeled using a 4-parameter logistic curve fit. The hyaluronidase activity of each unknown was calculated by interpolation from the calibration curve, corrected for sample dilution factor, and reported in U/mL.

Example 5

PEGylation of rHuPH20 rHuPH20 was PEGylated (PEGPH20) by reaction of the enzyme with linear N-hydroxysuccinimidyl ester of methoxy poly(ethylene glycol) butanoic acid (mPEG-SBA-30K).

A. Conjugation of mPEG-SBA-30K to rHuPH20 rHuPH20 (which is approximately 60 kDa in size), generated as described in Example 3, was covalently conjugated to a linear N-hydroxysuccinimidyl ester of methoxy poly (ethylene glycol) butanoic acid (mPEG-SBA-30K), having an approximate molecular weight of 30 kDa. The structure of mPEG-SBA is shown in scheme 2, below:

Scheme 2

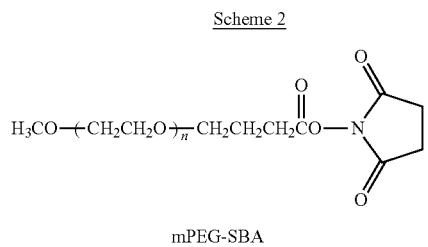

mPEG-SBA

Methods used to prepare the mPEG-SBA-30K that was used to PEGylate rHuPH20 are described, for example, in U.S. Pat. No. 5,672,662. Briefly, the mPEG-SBA-30K is made according to the following procedure:

A solution of ethylmalonate (2 equivalents) dissolved in dioxane is added drop by drop to sodium hydride (2 equivalents) and toluene under a nitrogen atmosphere. mPEG methane sulfonate (1 equivalent, MW 30 kDa, Shearwater) is dissolved in toluene and added to the above mixture. The resulting mixture is refluxed for approximately 18 hours. The reaction mixture is concentrated to half its original volume, extracted with 10% aqueous NaCl solution, extracted with 1% aqueous hydrochloric acid, and the aqueous extracts are combined. The collected aqueous layers are extracted with dichloromethane (3×) and the organic layer is dried with magnesium sulfate, filtered and evaporated to dryness. The resulting residue is dissolved in 1 N sodium hydroxide containing sodium chloride and the mixture is stirred for 1 hour. The pH of the mixture is adjusted to approximately 3 by addition of 6 N hydrochloric acid. The mixture is extracted with dichloromethane (2×).

The organic layer is dried over magnesium sulfate, filtered, concentrated, and poured into cold diethyl ether. The precipitate is collected by filtration and dried under vacuum. The resulting compound is dissolved in dioxane and refluxed for 8 hours and then concentrated to dryness. The resulting residue is dissolved in water and extracted with dichloromethane (2×), dried over magnesium sulfate, and the solution is concentrated by rotary evaporation and then poured into cold diethyl ether. The precipitate is collected by filtration and dried under vacuum. The resulting compound (1 equivalent) is dissolved in dichloromethane and N-hydroxysuccinimide (2.1 equivalents) is added. The solution is cooled to 0° C. and a solution of dicyclohexylcarbodiimide (2.1 equivalents) in dichloromethane is added dropwise. The solution is stirred at room temperature for approximately 18 hours. The reaction mixture is filtered, concentrated and precipitated in diethyl ether. The precipitate is collected by filtration and dried under vacuum to afford mPEG-SBA-30K.

To make the PEGylated rHuPH20, mPEG-SBA-30K was coupled to the amino group(s) of rHuPH20 by covalent conjugation, providing stable amide bonds between rHuPH20 and mPEG as shown in Scheme 3.

Scheme 3:

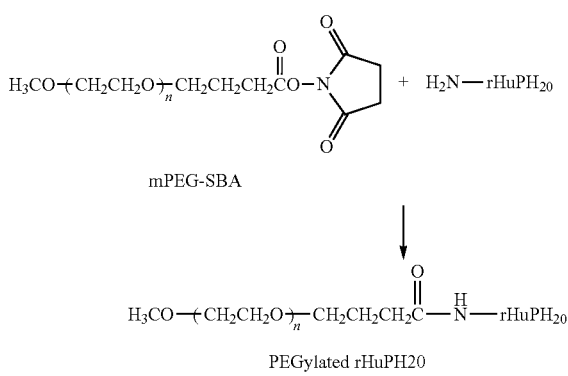

mPEG-SBA

PEGylated rHuPH20

For the conjugation, the mPEG-SBA-30K was added in powder form to rHuPH20 (at a concentration of 10 mg/mL in 130 mM NaCl/10 mM HEPES; pH 7). The PEG:rHuPH20 ratio was 10:1 (molar ratio). After the PEG had dissolved in the buffer, the solution was sterile-filtered (Corning 50 mL Tube top filter, polystyrene, cellulose acetate 0.22 μm membrane). The conjugation was carried out overnight, with stirring, at 4° C. in a cold room.

Following conjugation, the solution was concentrated, using a 100,000 MWCO TFF membrane, and buffer exchanged against 130 mM NaCl/10 mM HEPES at pH 6.8. The resulting material, which was tested for enzyme activity, as described in Example 4, above, was diluted using 130 mM NaCl/10 mM HEPES at pH 6.8 to obtain a final enzyme activity of 100,000 U/mL (corresponding to approximately 2.5 mg peptide/mL). This PEGylated rHuPH20 material was filled, in 1 mL volumes, into a 13-mm Type-1 glass vial with brombutyl seal, and stored frozen (frozen overnight in a −20° C. freezer, then put in a −80° C. freezer for longer storage).

B. Analysis of PEGylated rHuPH20

The PEGylated rHuPH20 material was assayed by gel electrophoresis. Three batches of PEGylated rHuPH20, made as in part A above, revealed an identical pattern of multiple bands, representing unreacted PEG and multiple species of mPEG-rHuPH20 conjugates, which migrated at different distances. Based on comparison with migration of a molecular weight marker, the bands representing the species ranged from approximately 90 kDa to 300 kDa, with three dark bands migrating above the 240 kDa marker. These data indicated that the PEGylated rHuPH20, generated by covalent conjugation of mPEG-SBA-30K, contained a heterogeneous mixture of PEGylated rHuPH20 species, likely including mono-, di- and tri-PEGylated proteins. The lack of a visible band at 60 kDa indicates that all the protein had reacted with the PEG, and that no detectable native rHuPH20 was present in the mixture.

Example 6

Effect of Anti-CTLA4 Antibody and Hyaluronidase in HA-High Syngeneic CT26 Tumor Mouse Model Mice containing HA-high CT26 syngeneic tumors were generated as described in Example 1A2, and were treated with PEGPH20 described in Example 5 alone or in combination with anti-CTLA4 or appropriate controls as follows:

A. Co-Administration of PEGPH20 and Anti-CTLA4

Mice containing HA-high CT26 syngeneic tumors, with a mean tumor volume of 185±24 mm$^3$, were randomized into treatment groups, each containing 7 mice, such that the mean tumor volume of each group was substantially the same. Treatments were administered twice weekly on days 1, 4, 8, and 11, as set forth in Table 11 below. PEGPH20 as described in Example 5 or Active Pharmaceutical Ingredient (API) buffer (10 mM histidine, 130 mM NaCl, pH 6.5) were administered intravenously (IV), and anti-CTLA4 (BioX-Cell Inc, Cat. No. BE0164), mouse IgG2b (BioXCell Inc, Cat. No. BE0086) isotype control, or saline were administered intraperitoneally (IP), all at the dose levels indicated. Tumor volumes were measured on days 0, 3, 7, 10 and 14. When tumor volumes reached 2000 mm$^3$, animals were sacrificed by carbon dioxide overdose.

TABLE 11

PEGPH20 and anti-CTLA4 Treatment Conditions

| Group | n | Treatment 1 | PEGPH20 dose (mg/kg) | Treatment 2 | IG dose (mg/kg) |
|---|---|---|---|---|---|
| 1 | 7 | API buffer | 0 | Saline | 0 |
| 2 | 7 | API buffer | 0 | Mouse IgG2b | 4 |
| 3 | 7 | PEGPH20 | 1, 0.0375* | Saline | 0 |
| 4 | 7 | API buffer | 0 | anti-CTLA4 | 2 |
| 5 | 7 | API buffer | 0 | anti-CTLA4 | 4 |
| 6 | 7 | API buffer | 0 | anti-CTLA4 | 8 |
| 7 | 7 | PEGPH20 | 1, 0.0375* | anti-CTLA4 | 4 |

*Dose of PEGPH20 was 1 mg/kg on day 1 and 0.0375 mg/kg on days 4, 8 and 11

The results are presented in Table 12. Tumor growth inhibition (TGI) was calculated using the following formula: 1-(tumor volume, test article$_{last\ day}$-tumor volume, test article$_{(baseline\ measurement)}$)/(tumor volume, vehicle$_{(last\ day)}$-tumor volume, vehicle$_{(baseline\ measurement)}$)×100%. The results show that tumors in control animals, administered saline alone (Group 1) or control antibody (Group 2) exhibited progressive growth over the course of the study. The tumors in animals administered PEGPH20 alone (Group 3) were reduced to about half the size of the untreated tumors at the completion of the study. The tumors in animals treated with anti-CTLA4 at any of the tested doses (Groups 4-6) also were reduced and to a somewhat greater extent than with PEGPH20 treatment. Administration of 2 mg/kg (Group 4) and 4 mg/kg (Group 5) anti-CTLA4 resulted in a similar reduction in tumor growth, with a greater reduction in tumor volume observed in the group administered 8 mg/kg anti-CTLA4 (Group 6). Compared to animals treated with either agent alone, co-administration of PEGPH20 and 4 mg/kg anti-CTLA4 resulted in an increased reduction in tumor volume. This reduction was greater than observed for any other treatment group at earlier times post-administration, but by day 14, as the tumor volume began to increase, the tumor size was substantially the same as observed in animals administered the maximum dose of anti-CTLA4 (8 mg/kg) (Group 6).

TABLE 12

Results

| | | Tumor volume (mm³), Mean ± SEM | | | | | |
|---|---|---|---|---|---|---|---|
| Group | Treatment | Day 0 | Day 3 | Day 7 | Day 10 | Day 14 | TGI |
| 1 | saline control | 186 ± 11 | 385 ± 17 | 630 ± 41 | 1030 ± 87 | 2243 ± 203 | — |
| 2 | 4 mg/kg IgG2b | 187 ± 9 | 336 ± 14 | 612 ± 43 | 866 ± 94 | 1773 ± 231 | — |
| 3 | PEGPH20 | 186 ± 10 | 231 ± 26 | 453 ± 45 | 743 ± 84 | 1427 ± 199 | 40% |
| 4 | 2 mg/kg α-CTLA4 | 186 ± 10 | 364 ± 15 | 576 ± 44 | 607 ± 35 | 1114 ± 103 | 55% |
| 5 | 4 mg/kg α-CTLA4 | 186 ± 9 | 367 ± 31 | 527 ± 37 | 540 ± 83 | 1157 ± 223 | 53% |
| 6 | 8 mg/kg α-CTLA4 | 185 ± 9 | 338 ± 22 | 530 ± 53 | 466 ± 57 | 952 ± 129 | 63% |
| 7 | PEGPH20 + 4 mg/kg α-CTLA4 | 185 ± 9 | 216 ± 27 | 352 ± 39 | 412 ± 55 | 982 ± 206 | 61% |

B. Comparison of Co-Administration Versus Pre-Administration of PEGPH20

To assess the effects of pre-administering PEGPH20 prior to treatment with anti-CTLA4 compared to co-administering PEGPH20 with anti-CTLA4, mice containing CT26/HAS3 tumors, with a mean tumor volume of 215±32 mm³, were randomized into treatment groups. Each group contained 9 mice, such that the mean tumor volume of each group was substantially the same. The treatments administered for each group are set forth in Table 13 below. For all treatments groups, PEGPH20 or API buffer was administered intravenously (IV) twice weekly on days 1, 4, 8 and 11. The mice also were administered saline, mouse IgG2b isotype control, or anti-CTLA4, which were administered intraperitoneally (IP), at the dose levels indicated in Table 13. Mice in Groups 4 and 5 were co-administered anti-CTLA4 antibody on the same day as the PEGPH20 treatment. For Group 6, mice were pre-administered PEGPH20 on the day before anti-CTLA4 treatment (days 0, 3, 7, and 10) as indicated, and administered anti-CTLA4 24 hours later (on days 1, 4, 8 and 11).

Tumor volumes were measured on days 0, 3, 7, 10 and 14. When tumor volumes reached 2000 mm³, animals were sacrificed by carbon dioxide overdose.

TABLE 13

PEGPH20 and anti-CTLA4 Treatment Conditions

| Group | n | Treatment 1 | PEGPH20 (mg/kg) | Treatment 2 | IG (mg/kg) |
|---|---|---|---|---|---|
| 1 | 9 | API buffer | 0 | Saline | 0 |
| 2 | 9 | API buffer | 0 | Mouse IgG2b | 4 |
| 3 | 9 | PEGPH20 | 0.0375 | Saline | 0 |
| 4 | 9 | API buffer | 0 | anti-CTLA4 | 4 |
| 5 | 9 | PEGPH20 | 0.0375 | anti-CTLA4 | 4 |
| 6 | 9 | PEGPH20* | 0.0375* | anti-CTLA4 | 4 |

*Dose of PEGPH20 for group 6 was administered 24 hours prior to dose of anti-CTLA4

The results are presented in Table 14. Tumor growth inhibition (TGI) was calculated using the following formula: 1−(tumor volume, test article$_{(last\ day)}$−tumor volume, test article$_{(baseline\ measurement)}$)/(tumor volume, vehicle$_{(last\ day)}$−tumor volume, vehicle$_{(baseline\ measurement)}$)×100%. Similar to the results in the previous study, the tumors in control animals, administered saline alone (Group 1) or control antibody (Group 2) exhibited progressive growth over the course of the study. The tumors in animals administered PEGPH20 alone (Group 3) were reduced to about half the size of the untreated tumors at the completion of the study (p<0.05 to vehicle). The average tumor size in animals administered only anti-CTLA4 (Group 4) also was reduced compared to those in control animals (p<0.05 to vehicle). The average tumor size in animals receiving PEGPH20 and anti-CTLA4 (Groups 5 and 6) were further reduced in volume compared to the individual treatments. The greatest reduction in tumor volume was observed in animals receiving PEGPH20 and anti-CTLA4, where the PEGPH20 was administered 24 hr prior to the anti-CTLA4 administration (Group 6) (p=0.0152 to anti-CTLA4 alone). The results of this study show there is a greater reduction in tumor growth when PEGPH20 and anti-CTLA4 are both administered, which is enhanced by administering PEGPH20 prior to administering anti-CTLA4.

TABLE 14

Results

| | | Tumor volume (mm³), Mean ± SEM | | | | | |
|---|---|---|---|---|---|---|---|
| Group | Treatment | Day 0 | Day 3 | Day 7 | Day 10 | Day 14 | TGI |
| 1 | saline control | 218 ± 12 | 381 ± 20 | 672 ± 54 | 1004 ± 95 | 1938 ± 154 | — |
| 2 | IgG2b control | 216 ± 12 | 377 ± 13 | 670 ± 42 | 1072 ± 72 | 2210 ± 203 | — |
| 3 | PEGPH20 | 215 ± 12 | 253 ± 15 | 429 ± 44 | 658 ± 81 | 1196 ± 183 | 43% |
| 4 | 4 mg/kg α-CTLA4 | 215 ± 11 | 367 ± 22 | 545 ± 36 | 574 ± 64 | 904 ± 117 | 60% |
| 5 | PEGPH20 + 4 mg/kg α-CTLA4 | 213 ± 10 | 258 ± 9 | 423 ± 23 | 479 ± 29 | 784 ± 56 | 67% |
| 6 | PEGPH20* + 4 mg/kg α-CTLA4 | 214 ± 11 | 242 ± 10 | 351 ± 24 | 378 ± 49 | 573 ± 77 | 79% |

*Dose of PEGPH20 for group 6 was administered 24 hours prior to dose of anti-CTLA4

C. Dose-Dependent Effect of Anti-CTLA4 Pre-, Post- and Co-Administered with PEGPH20

To assess the effect of pre-, post- or co-administration of PEGPH20 with anti-CTLA4, mice containing CT26/HAS3 tumors, with a mean tumor volume of 201±27 mm$^3$, were randomized into treatment groups, each containing 9 mice, such that the mean tumor volume of each group was substantially the same. The dosage regime is set forth in Table 15. For all treatment groups except Group 9, PEGPH20 or API buffer control were administered intravenously (IV) twice weekly on days 1, 4, 8 and 11. Groups 4, 5 and 7 also were administered anti-CTLA4 at days 1, 4, 8 and 11, with Groups 5 and 7 receiving a co-administration of 0.0375 mg PEGPH20 and either 1 mg/kg anti-CTLA4 (Group 5) or 4 mg/kg anti-CTLA4 (Group 7). Groups 6 and 8 mice were pre-administered PEGPH20 on the day before anti-CTLA4 treatment (days 0, 3, 7, and 10), and 24 hours later (on days 1, 4, 8 and 11) were administered 1 mg/kg or 4 mg/kg anti-CTLA4, respectively. For Group 9, PEGPH20 was given as a post-administration where mice were administered anti-CTLA4 on days 0, 3, 7 and 10 and, 24 hours later, PEGPH20 was administered on days 1, 4, 8 and 11.

PEGPH20 or API buffer were administered intravenously (IV), and anti-CTLA4, mouse IgG2b isotype control, or saline were administered intraperitoneally (IP), all at the dose levels indicated. Tumor volumes were measured on days 0, 3, 7, 10 and 14.

TABLE 15

PEGPH20 and anti-CTLA4 Treatment Conditions

| Group | n | Treatment 1 | PEGPH20 dose (mg/kg) | Treatment 2 | IG dose (mg/kg) |
|---|---|---|---|---|---|
| 1 | 9 | API buffer | 0 | Saline | 0 |
| 2 | 9 | API buffer | 0 | Mouse IgG2b | 4 |
| 3 | 9 | PEGPH20 | 0.0375 | Saline | 0 |
| 4 | 9 | API buffer | 0 | anti-CTLA4 | 1 |
| 5 | 9 | API buffer | 0 | anti-CTLA4 | 4 |
| 6 | 9 | PEGPH20* | 0.0375* | anti-CTLA4 | 1 |
| 7 | 9 | PEGPH20 | 0.0375 | anti-CTLA4 | 4 |
| 8 | 9 | PEGPH20* | 0.0375* | anti-CTLA4 | 4 |
| 9 | 9 | PEGPH20** | 0.0375** | anti-CTLA4 | 4 |

*Dose of PEGPH20 was administered 24 hours prior to dose of anti-CTLA4.
**Dose of PEGPH20 was administered 24 hours after dose of anti-CTLA4.

The results are presented in Table 16. Tumor growth inhibition (TGI) was calculated using the following formula: 1−(tumor volume, test article$_{(last\ day)}$−tumor volume, test article$_{(baseline\ measurement)}$)/(tumor volume, vehicle$_{(last\ day)}$−tumor volume, vehicle$_{(baseline\ measurement)}$)×100%. Similar to the results of the previously presented experiments, the tumors in control animals, administered saline alone (Group 1) or control antibody (Group 2) exhibited progressive growth over the course of the study. The animals administered PEGPH20 alone (Group 3) exhibited a final 41% tumor growth inhibition (TGI), compared to control animals. Administration of anti-CTLA4 alone, at 1 mg/kg (Group 4) or 4 mg/kg (Group 5), resulted in TGI of 49% and 57% TGI, respectively.

Co-administration of PEGPH20 and anti-CTLA4 at 1 mg/kg and 4 mg/kg gave a TGI of 57% and a 65%, respectively. Consistent with the results described above, co-administration of PEGPH20 increased TGI compared to administration of either agent alone. The results show that pre-administering PEGPH20 further increases the observed TGI, while post-administration of PEGPH20 after treating with anti-CTLA4 did not further increase the TGI. For example, pre-administering PEGPH20 prior to administering 4 mg/kg anti-CTLA4 resulted in an increase in TGI from 65% when the agents were co-administered to 79% when the PEGPH20 was administered 24 h prior to administration of the antibody (p=0.0011 to anti-CTLA4 alone). A lesser effect was observed when PEGPH20 was pre-administered 24 h before treatment with 1 mg/kg anti-CTLA4 (p=0.0641 to anti-CTLA4 alone). When PEGPH20 was given post-administration of the 4 mg/kg anti-CTLA4, there was no benefit of PEGPH20 (p=0.35 to anti-CTLA4 alone). The results show that a dosage regime in which PEGPH20 is pre-administered prior to administration of the anti-CTLA4 antibody results in a substantial increase in TGI.

TABLE 16

Results

| | | Tumor volume (mm$^3$), Mean ± SEM | | | | | |
|---|---|---|---|---|---|---|---|
| Group | Treatment | Day 0 | Day 3 | Day 7 | Day 10 | Bay 14 | TGI |
| 1 | saline control | 202 ± 10 | 339 ± 14 | 589 ± 40 | 1005 ± 99 | 1960 ± 212 | — |
| 2 | IgG2b control | 202 ± 10 | 331 ± 6 | 556 ± 39 | 998 ± 78 | 2117 ± 114 | — |
| 3 | PEGPH20 | 201 ± 10 | 243 ± 15 | 387 ± 36 | 648 ± 73 | 1245 ± 167 | 41% |
| 4 | 1 mg/kg α-CTLA4 | 201 ± 9 | 335 ± 17 | 479 ± 41 | 679 ± 98 | 1090 ± 178 | 49% |
| 5 | 4 mg/kg α-CTLA4 | 201 ± 9 | 328 ± 10 | 448 ± 22 | 559 ± 45 | 965 ± 126 | 57% |
| 6 | PEGPH20* + 1 mg/kg α-CTLA4 | 201 ± 9 | 249 ± 11 | 351 ± 13 | 531 ± 46 | 929 ± 103 | 59% |
| 7 | PEGPH20 + 4 mg/kg α-CTLA4 | 202 ± 9 | 249 ± 17 | 353 ± 12 | 492 ± 24 | 822 ± 62 | 65% |
| 8 | PEGPH20* + 4 mg/kg α-CTLA4 | 202 ± 9 | 245 ± 17 | 292 ± 14 | 377 ± 34 | 579 ± 56 | 79% |
| 9 | PEGPH20** + 4 mg/kg α-CTLA4 | 201 ± 10 | 265 ± 9 | 375 ± 25 | 538 ± 50 | 990 ± 101 | 55% |

*Dose of PEGPH20 was administered 24 hours prior to dose of anti-CTLA4.
**Dose of PEGPH20 was administered 24 hours after dose of anti-CTLA4.

D. Dose-Dependent Effect of Pre-Administered PEGPH20

To assess if the effects of pre-administering PEGPH20 were dose-dependent, mice containing CT26/HAS3 tumors, with a mean tumor volume of 211±33 mm$^3$, were randomized into treatment groups. Each treatment group contained 10 mice, such that the mean tumor volume of each group was substantially the same. The dosage regime for the treated groups is set forth in Table 17. For all treatment groups, 0 (API buffer control) or 0.0375 mg/kg or 1 mg/kg PEGPH20 were administered intravenously (IV) twice weekly on days 1, 4, 8 and 11. Group 4 also was administered 4 mg/kg anti-CTLA4 on days 1, 4, 8 and 11. For groups 5 and 6, mice were pre-administered PEGPH20 on days 0, 3, 7 and 10 at 1 mg/kg or 0.0375 mg/kg, respectively, as indicated in Table 17 and, 24 hours later, were administered anti-CTLA4 on days 1, 4, 8 and 11. The anti-CTLA4 or saline treatments were administered intraperitoneally (IP). Tumor volumes were measured on days 0, 3, 7, 10 and 14.

pre-administered PEGPH20 at 0.0375 or 1 mg/kg, exhibited a further reduced tumor volume compared to animals treated with only anti-CTLA4, with little difference between the different doses of PEGPH20.

TABLE 18

| | | Results | | | | | |
|---|---|---|---|---|---|---|---|
| | | Tumor volume (mm$^3$), Mean ± SEM | | | | | |
| Group | Treatment | Day 0 | Day 3 | Day 7 | Day 10 | Day 14 | TGI |
| 1 | saline control | 212 ± 12 | 359 ± 18 | 610 ± 26 | 946 ± 76 | 1908 ± 196 | — |
| 2 | 37.5 µg/kg PEGPH20 | 211 ± 11 | 262 ± 10 | 527 ± 19 | 904 ± 48 | 1820 ± 106 | 5% |
| 3 | 1 mg/kg PEGPH20 | 212 ± 11 | 238 ± 10 | 497 ± 27 | 878 ± 74 | 1735 ± 137 | 10% |
| 4 | 4 mg/kg α-CTLA4 | 212 ± 11 | 358 ± 17 | 509 ± 35 | 594 ± 66 | 972 ± 117 | 55% |
| 5 | 1 mg/kg PEGPH20* + 4 mg/kg α-CTLA4 | 210 ± 10 | 230 ± 20 | 315 ± 21 | 518 ± 43 | 816 ± 87 | 64% |
| 6 | 37.5 µg/kg PEGPH20* + 4 mg/kg α-CTLA4 | 211 ± 10 | 258 ± 13 | 326 ± 23 | 460 ± 41 | 758 ± 82 | 68% |

TABLE 17

PEGPH20 and anti-CTLA4 Treatment Conditions

| Group | n | Treatment 1 | PEGPH20 dose (mg/kg) | Treatment 2 | IG dose (mg/kg) |
|---|---|---|---|---|---|
| 1 | 10 | API buffer | 0 | Saline | 0 |
| 2 | 10 | PEGPH20 | 0.0375 | Saline | 0 |
| 3 | 10 | PEGPH20 | 1 | Saline | 0 |
| 4 | 10 | API buffer | 0 | anti-CTLA4 | 4 |
| 5 | 10 | PEGPH20* | 1* | anti-CTLA4 | 4 |
| 6 | 10 | PEGPH20* | 0.0375* | anti-CTLA4 | 4 |

*Dose of PEGPH20 for groups 5 and 6 was administered 24 hours prior to dose of anti-CTLA4.

The results are presented in Table 18. Tumor growth inhibition (TGI) was calculated using the following formula: 1-(tumor volume, test article$_{(last\ day)}$-tumor volume, test article$_{(baseline\ measurement)}$)/(tumor volume, vehicle$_{(last\ day)}$-tumor volume, vehicle$_{(baseline\ measurement)}$)×100%. Similar to the results described above, the tumors in control animals, administered saline alone (Group 1) exhibited progressive growth over the course of the study. The animals administered PEGPH20 alone, at 0.0375 mg/kg (Group 2) or 1 mg/kg (Group 3), exhibited slightly reduced average tumor volumes compared to control animals. It is possible the reduced efficacy of PEGPH20 observed in this experiment is due to the presence of less tumoral HA in the animals used in these experiments. Administration of anti-CTLA4 (4 mg/kg) alone (Group 4), resulted in a slightly greater than a 50% reduction in tumor volume compared to vehicle control. Animals receiving anti-CTLA4 in combination with Example 7

Effect of Anti-PD-L1 Antibody and Pre-Administered Hyaluronidase in HA-High Syngeneic MH194+PSC4 Tumor Mouse Model Mice containing HA-high MH194+PSC4 syngeneic tumors generated as described in Example 1, with a mean tumor volume of 168±24 mm$^3$, were randomized into treatment groups, each containing 8 mice, such that the mean tumor volume of each group were substantially the same. PEGPH20 as described in Example 5 or Active Pharmaceutical Ingredient (API) buffer (10 mM histidine, 130 mM NaCl, pH 6.5) were administered intravenously (IV) on days 0, 3, 7, 10, 14, and 17, and anti-PD-L1 (BioXCell Inc, clone 10F.9G2, Cat. No. BE0101) or rat IgG2b (BioXCell Inc, Cat. No. BE0090) isotype control were administered intraperitoneally (IP) on days 1, 4, 8, 11, 15, and 18, all at the dose levels indicated in Table 19. Tumor volumes were measured on days 0, 3, 7, 10, 14, 17, and 21.

TABLE 19

PEGPH20 and anti-PD-L1 Treatment Conditions

| Group | n | Treatment 1 | PEGPH20 dose (mg/kg) | Treatment 2 | IG dose (mg/kg) |
|---|---|---|---|---|---|
| 1 | 8 | API buffer | 0* | Rat IgG2b | 4 |
| 2 | 8 | PEGPH20 | 1* | Rat IgG2b | 4 |
| 3 | 8 | API buffer | 0* | anti-PD-L1 | 1 |
| 4 | 8 | PEGPH20 | 1* | anti-PD-L1 | 1 |
| 5 | 8 | API buffer | 0* | anti-PD-L1 | 2 |
| 6 | 8 | PEGPH20 | 1* | anti-PD-L1 | 2 |
| 7 | 8 | API buffer | 0* | anti-PD-L1 | 4 |
| 8 | 8 | PEGPH20 | 1* | anti-PD-L1 | 4 |

*PEGPH20 or API buffer was administered 24 hours prior to dose of anti-PD-L1.

The results are presented in Table 20. Tumor growth inhibition (TGI) was calculated using the following formula: 1-(tumor volume, test article$_{(last\ day)}$-tumor volume, test article$_{(baseline\ measurement)}$)/(tumor volume, vehicle$_{(last\ day)}$-tumor volume, vehicle$_{(baseline\ measurement)}$)×100%. The results showed that high-HA MH194+PSC4 tumors in control animals, administered API buffer and isotype control alone (Group 1) exhibited progressive growth over the course of the study. The growth of tumors in animals administered PEGPH20 alone (Group 2) was reduced significantly (p=0.004 to Group 1) to about ⅔ of the size of the vehicle/isotype-treated tumors at the completion of the study. The growth of tumors in animals treated with anti-PD-L1 at any of the tested doses (Groups 3, 5, and 7) also was reduced significantly (p=0.0015, 0.0008, and <0.0001, respectively, for anti-PD-L1 at 1, 2, and 4 mg/kg). Administration of PEGPH20 at 1 mg/kg 24 h prior to 2 mg/kg of anti-PD-L1 (Group 6) resulted in an significantly increased reduction in tumor volume compared to 2 mg/kg of anti-PD-L1 alone (p=0.005) or 1 mg/kg of PEGPH20 alone (p=0.007). The results show that the combination treatment with PEGPH20 and anti-PD-L1 reduces tumor growth better than PEGPH20 or anti-PD-L1 individually.

TABLE 20

Results

| Group | Treatment | Tumor volume (mm³), Mean ± SEM | | | |
|---|---|---|---|---|---|
| | | Day 0 | Day 3 | Day 7 | Day 10 |
| 1 | API buffer* + 4 mg/kg rat IgG2b | 172 ± 8 | 277 ± 17 | 469 ± 22 | 581 ± 38 |
| 2 | 1 mg/kg PEGPH20* + 4 mg/kg rat IgG2b | 171 ± 8 | 254 ± 14 | 318 ± 29 | 479 ± 42 |
| 3 | API buffer* + 1 mg/kg α-PD-L1 | 170 ± 9 | 315 ± 17 | 506 ± 33 | 587 ± 32 |
| 4 | 1 mg/kg PEGPH20* + 1 mg/kg α-PD-L1 | 164 ± 6 | 223 ± 13 | 300 ± 31 | 452 ± 46 |
| 5 | API buffer* + 2 mg/kg α-PD-L1 | 171 ± 8 | 294 ± 16 | 427 ± 44 | 553 ± 47 |
| 6 | 1 mg/kg PEGPH20* + 2 mg/kg α-PD-L1 | 164 ± 10 | 237 ± 7 | 270 ± 26 | 372 ± 23 |
| 7 | API buffer* + 4 mg/kg α-PD-L1 | 169 ± 12 | 294 ± 19 | 321 ± 23 | 309 ± 32 |
| 8 | 1 mg/kg PEGPH20* + 4 mg/kg α-PD-L1 | 162 ± 9 | 249 ± 12 | 247 ± 22 | 303 ± 28 |

| Group | Treatment | Tumor volume (mm³), Mean ± SEM | | | TGI |
|---|---|---|---|---|---|
| | | Day 14 | Day 17 | Day 21 | |
| 1 | API buffer* + 4 mg/kg rat IgG2b | 852 ± 70 | 1182 ± 86 | 2145 ± 140 | — |
| 2 | 1 mg/kg PEGPH20* + 4 mg/kg rat IgG2b | 647 ± 64 | 937 ± 86 | 1468 ± 112 | 34% |
| 3 | API buffer* + 1 mg/kg α-PD-L1 | 739 ± 56 | 1016 ± 100 | 1626 ± 109 | 26% |
| 4 | 1 mg/kg PEGPH20* + 1 mg/kg α-PD-L1 | 578 ± 65 | 774 ± 101 | 1300 ± 211 | 43% |
| 5 | API buffer* + 2 mg/kg α-PD-L1 | 613 ± 72 | 909 ± 136 | 1761 ± 226 | 19% |
| 6 | 1 mg/kg PEGPH20* + 2 mg/kg α-PD-L1 | 398 ± 46 | 578 ± 72 | 1029 ± 139 | 57% |
| 7 | API buffer* + 4 mg/kg α-PD-L1 | 332 ± 60 | 384 ± 78 | 667 ± 158 | 75% |
| 8 | 1 mg/kg PEGPH20* + 4 mg/kg α-PD-L1 | 343 ± 40 | 421 ± 65 | 664 ± 88 | 75% |

*API buffer or PEGPH20 was administered 24 hours prior to dose of anti-PD-L1 or isotype control.

Example 8

Effect of Anti-PD-L1 Antibody and Lower Dose of Pre-Administered Hyaluronidase in HA-High Syngeneic MH194+PSC4 Tumor Mouse Model Mice containing HA-high MH194+PSC4 syngeneic tumors generated as described in Example 1, with a mean tumor volume of 131±20 mm³, were randomized into treatment groups, each containing 8 mice, such that the mean tumor volume of each group were substantially the same. PEGPH20 as described in Example 5 or Active Pharmaceutical Ingredient (API) buffer (10 mM histidine, 130 mM NaCl, pH 6.5) were administered intravenously (IV) on days 0, 3, 6, 8, 12, 15, and 19, and anti-PD-L1 (BioXCell Inc, clone 10F.9G2, Cat. No. BE0101) or rat IgG2b (BioXCell Inc, Cat. No. BE0090) isotype control were administered intraperitoneally (IP) on days 1, 4, 7, 9, 13, 16, and 20, all at the dose levels indicated in Table 21. Tumor volumes were measured on days 0, 2, 6, 9, 13, 16, and 20.

TABLE 21

PEGPH20 and anti-PD-L1 Treatment Conditions

| Group | n | Treatment 1 | PEGPH20 dose (mg/kg) | Treatment 2 | IG dose (mg/kg) |
|---|---|---|---|---|---|
| 1 | 8 | API buffer | 0* | Rat IgG2b | 2 |
| 2 | 8 | API buffer | 0* | anti-PD-L1 | 2 |
| 3 | 8 | PEGPH20 | 1* | Rat IgG2b | 2 |
| 4 | 8 | PEGPH20 | 1* | anti-PD-L1 | 2 |

TABLE 21-continued

PEGPH20 and anti-PD-L1 Treatment Conditions

| Group | n | Treatment 1 | PEGPH20 dose (mg/kg) | Treatment 2 | IG dose (mg/kg) |
|---|---|---|---|---|---|
| 5 | 8 | PEGPH20 | 0.0375* | Rat IgG2b | 2 |
| 6 | 8 | PEGPH20 | 0.0375* | anti-PD-L1 | 2 |

*PEGPH20 or API buffer was administered 24 hours prior to dose of IgG2b or anti-PD-L1.

37.5 μg/kg is a human equivalent dose of the PEGPH20, where the human dose is 3 μg/kg. The results are presented in Table 22. Tumor growth inhibition (TGI) was calculated using the following formula: 1-(tumor volume, test article$_{(last\ day)}$-tumor volume, test article$_{(baseline\ measurement)}$/(tumor volume, vehicle$_{(last\ day)}$-tumor volume, vehicle$_{(baseline\ measurement)}$)×100%. The results showed that high-HA MH194+PSC4 tumors in control animals, administered API buffer and isotype control alone (Group 1) exhibited progressive growth over the course of the study. The growth of tumors in animals administered anti-PD-L1 alone (Group 2) was reduced significantly (p=0.049 to Group 1) to about ⅔ of the size of the vehicle/isotype-treated tumors at the completion of the study. Administration of PEGPH20 at 37.5 μg/kg 24 h prior to 2 mg/kg of anti-PD-L1 (Group 6) resulted in a significantly increased reduction in tumor volume compared to 2 mg/kg of anti-PD-L1 alone (p<0.0001) or 37.5 μg/kg of PEGPH20 alone (p<0.0001), and also resulted in an significantly enhanced tumor growth inhibition when compared to PEGPH20 at 1 mg/kg 24 h prior to 2 mg/kg of anti-PD-L1 (Group 4) (p<0.0001).

The results show that the combination treatment with 37.5 μg/kg of PEGPH20 and anti-PD-L1 reduces tumor growth better than the combination of 1 mg/kg of PEGPH20 and anti-PD-L1. This dosage is the rodent dosage that corresponds to dosages used in human. Hence, the dosage of the hyaluronan-degrading enzyme can be titrated or selected.

TABLE 22

Results

| | | Tumor volume (mm³), Mean ± SEM | | | |
|---|---|---|---|---|---|
| Group | Treatment | Day 0 | Day 2 | Day 6 | Day 9 |
| 1 | API buffer* + 2 mg/kg rat IgG2b | 129 ± 8 | 272 ± 13 | 399 ± 20 | 523 ± 35 |
| 2 | API buffer* + 2 mg/kg α-PD-L1 | 134 ± 8 | 240 ± 27 | 323 ± 33 | 317 ± 50 |
| 3 | 1 mg/kg PEGPH20* + 2 mg/kg rat IgG2b | 130 ± 8 | 262 ± 30 | 330 ± 30 | 428 ± 47 |
| 4 | 1 mg/kg PEGPH20* + 2 mg/kg α-PD-L1 | 131 ± 8 | 178 ± 10 | 208 ± 21 | 252 ± 54 |
| 5 | 37.5 μg/kg PEGPH20* + 2 mg/kg rat IgG2b | 129 ± 5 | 192 ± 15 | 331 ± 40 | 441 ± 42 |
| 6 | 37.5 μg/kg PEGPH20* + 2 mg/kg α-PD-L1 | 134 ± 7 | 233 ± 24 | 225 ± 35 | 146 ± 28 |

| | | Tumor volume (mm³), Mean ± SEM | | | |
|---|---|---|---|---|---|
| Group | Treatment | Day 13 | Day 16 | Day 20 | TGI |
| 1 | API buffer* + 2 mg/kg rat IgG2b | 777 ± 75 | 1064 ± 113 | 1362 ± 135 | — |
| 2 | API buffer* + 2 mg/kg α-PD-L1 | 606 ± 90 | 834 ± 154 | 982 ± 217 | 31% |
| 3 | 1 mg/kg PEGPH20* + 2 mg/kg rat IgG2b | 717 ± 83 | 943 ± 128 | 1420 ± 227 | −5% |
| 4 | 1 mg/kg PEGPH20* + 2 mg/kg α-PD-L1 | 388 ± 77 | 582 ± 91 | 701 ± 167 | 54% |
| 5 | 37.5 μg/kg PEGPH20* + 2 mg/kg rat IgG2b | 715 ± 64 | 1013 ± 54 | 1493 ± 91 | −11% |
| 6 | 37.5 μg/kg PEGPH20* + 2 mg/kg α-PD-L1 | 146 ± 38 | 259 ± 59 | 270 ± 76 | 89% |

*API buffer or PEGPH20 was administered 24 hours prior to dose of anti-PD-L1 or isotype control.

Example 9

Effect of Anti-PD-1 Antibody and Pre-Administered Hyaluronidase in HA-High Syngeneic MH194+PSC4 Tumor Mouse Model Mice containing HA-high MH194+PSC4 syngeneic tumors were generated as described in Example 1, and were treated with PEGPH20 described in Example 5 alone and in combination with anti-PD-1 or appropriate controls as follows:

A. PEGPH20 Pre-Administration and High Dose of Anti-PD-1

Mice containing HA-high MH194+PSC4 syngeneic tumors with a mean tumor volume of 128±24 mm$^3$, were randomized into treatment groups, each containing 8 mice, such that the mean tumor volume of each group were substantially the same. PEGPH20 as described in Example 5 or Active Pharmaceutical Ingredient (API) buffer (10 mM histidine, 130 mM NaCl, pH 6.5) were administered intravenously (IV) on days 0, 3, 7, 10, 14, 17, and 21, and anti-PD-1 (BioXCell Inc, clone RMP1-14, Cat. No. BE0146) or saline were administered intraperitoneally (IP) on days 1, 4, 8, 11, 15, and 18, all at the dose levels indicated in Table 23. Tumor volumes were measured on days 0, 3, 7, 10, 14, 17, and 21.

TABLE 23

PEGPH20 and anti-PD-1 Treatment Conditions

| Group | n | Treatment 1 | PEGPH20 dose (mg/kg) | Treatment 2 | IG dose (mg/kg) |
|---|---|---|---|---|---|
| 1 | 8 | API buffer | 0* | Saline | 0 |
| 2 | 8 | PEGPH20 | 1* | Saline | 0 |
| 3 | 8 | API buffer | 0* | anti-PD-1 | 4 |
| 4 | 8 | PEGPH20 | 1* | anti-PD-1 | 4 |

*PEGPH20 or API buffer was administered 24 hours prior to dose of anti-PD-1.

The results are presented in Table 24. Tumor growth inhibition (TGI) was calculated using the following formula: 1-(tumor volume, test article$_{(last\ day)}$-tumor volume, test article$_{(baseline\ measurement)}$)/(tumor volume, vehicle$_{(last\ day)}$-tumor volume, vehicle$_{(baseline\ measurement)}$)×100%. The results showed that the growth of tumors in animals administered PEGPH20 alone (Group 2) was reduced significantly (p<0.0001 to Group 1) to about half of the size of the vehicle-treated tumors (Group 1) at the completion of the study. The growth of tumors in animals treated with anti-PD-1 at 4 mg/kg (Group 3) was almost completely inhibited (p<0.0001), and administration of PEGPH20 at 1 mg/kg 24 h prior to 4 mg/kg of anti-PD-1 (Group 4) did not result in any additional reduction in tumor volume compared to 4 mg/kg of anti-PD-1 alone (p=0.63).

TABLE 24

Results

| Group | Treatment | Tumor volume (mm$^3$), Mean ± SEM | | | |
|---|---|---|---|---|---|
| | | Day 0 | Day 3 | Day 7 | Day 10 |
| 1 | API buffer* + saline | 129 ± 11 | 242 ± 13 | 353 ± 23 | 435 ± 33 |
| 2 | 1 mg/kg PEGPH20* + saline | 124 ± 7 | 179 ± 17 | 275 ± 16 | 320 ± 25 |
| 3 | API buffer* + 4 mg/kg α-PD-1 | 130 ± 8 | 198 ± 17 | 262 ± 32 | 223 ± 22 |
| 4 | 1 mg/kg PEGPH20* + 4 mg/kg α-PD-1 | 128 ± 9 | 153 ± 14 | 188 ± 23 | 205 ± 19 |

| Group | Treatment | Tumor volume (mm$^3$), Mean ± SEM | | | TGI |
|---|---|---|---|---|---|
| | | Day 14 | Day 17 | Day 21 | |
| 1 | API buffer* + saline | 688 ± 65 | 1068 ± 116 | 1930 ± 215 | — |
| 2 | 1 mg/kg PEGPH20* + saline | 493 ± 40 | 784 ± 58 | 1168 ± 102 | 42% |
| 3 | API buffer* + 4 mg/kg α-PD-1 | 181 ± 27 | 211 ± 52 | 222 ± 75 | 95% |
| 4 | 1 mg/kg PEGPH20* + 4 mg/kg α-PD-1 | 233 ± 34 | 272 ± 90 | 422 ± 142 | 84% |

*API buffer or PEGPH20 was administered 24 hours prior to dose of anti-PD-1 or saline.

B. PEGPH20 Pre-Administration and Lower Dose of anti-PD-1, Treatment Begun at Different Tumor Sizes Mice containing HA-high MH194+PSC4 syngeneic tumors with a mean tumor volume of 138±24 mm$^3$, were randomized into treatment groups, each containing 8 mice, such that the mean tumor volume of each group were substantially the same. PEGPH20 as described in Example 5 or Active Pharmaceutical Ingredient (API) buffer (10 mM histidine, 130 mM NaCl, pH 6.5) were administered intravenously (IV) on days 0 (groups 1-4 only), 3 (groups 1-7 only), 7, 10, 14, 17, and 21, and anti-PD-1 (BioXCell Inc, clone RMP1-14, Cat. No. BE0146) or rat IgG2a (BioXCell Inc, Cat. No. BE0089) isotype control were administered intraperitoneally (IP) on days 1 (groups 1-4 only), 4 (groups 1-7 only), 8, 11, 15, and 18, all at the dose levels indicated in Table 23. Tumor volumes were measured on days 0, 3, 7, 10, 14, 17, and 21, except as indicated for groups 8-10 in Table 25.

TABLE 25

PEGPH20 and anti-PD-1 Treatment Conditions

| Group | n | Treatment 1 | PEGPH20 dose (mg/kg) | Treatment 2 | IG dose (mg/kg) |
|---|---|---|---|---|---|
| 1 | 8 | API buffer | 0* | Rat IgG2a | 2 |
| 2 | 8 | PEGPH20 | 1* | Rat IgG2a | 2 |
| 3 | 8 | API buffer | 0* | anti-PD-1 | 2 |
| 4 | 8 | PEGPH20 | 1* | anti-PD-1 | 2 |
| 5** | 8 | PEGPH20 | 1* | Rat IgG2a | 2 |
| 6** | 8 | API buffer | 0* | anti-PD-1 | 2 |
| 7** | 8 | PEGPH20 | 1* | anti-PD-1 | 2 |
| 8*** | 8 | PEGPH20 | 1* | Rat IgG2a | 2 |
| 9*** | 8 | API buffer | 0* | anti-PD-1 | 2 |
| 10*** | 8 | PEGPH20 | 1* | anti-PD-1 | 2 |

*PEGPH20 or API buffer was administered 24 hours prior to dose of anti-PD-1.
**Treatment delayed until tumor size average was approximately 300 mm³ (day 3 of study).
***Treatment delayed until tumor size average was approximately 400 mm³ (day 7 of study).

The results are presented in Table 26. Tumor growth inhibition (TGI) was calculated using the following formula: 1-(tumor volume, test article$_{(last\ day)}$-tumor volume, test article$_{(baseline\ measurement)}$)/(tumor volume, vehicle$_{(last\ day)}$-tumor volume, vehicle$_{(baseline\ measurement)}$)×100%. When treatment started on study day 0, the results showed that the growth of tumors in animals administered PEGPH20 alone (Group 2) or anti-PD-1 alone (Group 3) was reduced significantly (p=0.0021 and <0.0001, respectively, to Group 1) to about half of the size of the vehicle-treated tumors (Group 1) at the completion of the study. Administration of PEGPH20 at 1 mg/kg 24 h prior to 2 mg/kg of anti-PD-1 (Group 4) did not result in any additional reduction in tumor volume compared to 2 mg/kg of anti-PD-1 alone (p=0.07). When treatment was instead begun on study day 3 (Groups 5-7), anti-PD-1 still had a significant inhibitory effect on tumor growth (p<0.0001), and again no additional effect was observed in the presence of PEGPH20. Finally, when treatment was begun on study day 7 (Groups 8-10), the effect of anti-PD-1 alone or PEGPH20 alone was no longer significant (p=0.70), and the effect of the combination was not significantly different from that of PEGPH20 alone (p=0.45). Hence, PEGPH20 did not enhance the effectiveness of anti-PD-1 in this tumor model.

TABLE 26

Results

| Group | Treatment | Tumor volume (mm³), Mean ± SIM | | | |
|---|---|---|---|---|---|
| | | Day 0 | Day 3 | Day 7 | Day 10 |
| 1 | API buffer* + 2 mg/kg rat IgG2a | 137 ± 7 | 308 ± 19 | 418 ± 36 | 559 ± 56 |
| 2 | 1 mg/kg PEGPH20* + 2 mg/kg rat IgG2a | 138 ± 4 | 225 ± 14 | 336 ± 24 | 447 ± 29 |
| 3 | API buffer* + 2 mg/kg α-PD-1 | 140 ± 10 | 265 ± 26 | 384 ± 56 | 437 ± 78 |
| 4 | 1 mg/kg PEGPH20* + 2 mg/kg α-PD-1 | 142 ± 12 | 200 ± 18 | 237 ± 30 | 218 ± 15 |
| 5** | 1 mg/kg PEGPH20* + 2 mg/kg rat IgG2a | 135 ± 8 | 245 ± 24 | 332 ± 20 | 389 ± 31 |
| 6** | API buffer* + 2 mg/kg α-PD-1 | 137 ± 9 | 278 ± 14 | 335 ± 20 | 310 ± 20 |
| 7** | 1 mg/kg PEGPH20* + 2 mg/kg α-PD-1 | 136 ± 11 | 291 ± 16 | 280 ± 20 | 379 ± 34 |
| 8*** | 1 mg/kg PEGPH20* + 2 mg/kg rat IgG2a | 138 ± 10 | not measured | 418 ± 44 | 424 ± 53 |
| 9*** | API buffer* + 2 mg/kg α-PD-1 | 138 ± 9 | | 429 ± 27 | 570 ± 52 |
| 10*** | 1 mg/kg PEGPH20* + 2 mg/kg α-PD-1 | 136 ± 8 | | 382 ± 47 | 371 ± 37 |

| Group | Treatment | Tumor volume (mm³), Mean ± SEM | | | TGI |
|---|---|---|---|---|---|
| | | Day 14 | Day 17 | Day 21 | |
| 1 | API buffer* + 2 mg/kg rat IgG2a | 868 ± 78 | 1209 ± 147 | 2196 ± 215 | — |
| 2 | 1 mg/kg PEGPH20* + 2 mg/kg rat IgG2a | 538 ± 45 | 716 ± 44 | 1317 ± 75 | 43% |
| 3 | API buffer* + 2 mg/kg α-PD-1 | 471 ± 77 | 554 ± 97 | 1063 ± 249 | 55% |
| 4 | 1 mg/kg PEGPH20* + 2 mg/kg α-PD-1 | 309 ± 33 | 407 ± 59 | 775 ± 133 | 69% |
| 5** | 1 mg/kg PEGPH20* + 2 mg/kg rat IgG2a | 617 ± 59 | 819 ± 74 | 1589 ± 158 | 29% |
| 6** | API buffer* + 2 mg/kg α-PD-1 | 345 ± 40 | 442 ± 78 | 797 ± 148 | 68% |
| 7** | 1 mg/kg PEGPH20* + 2 mg/kg α-PD-1 | 458 ± 37 | 574 ± 64 | 1033 ± 129 | 57% |
| 8*** | 1 mg/kg PEGPH20* + 2 mg/kg rat IgG2a | 648 ± 63 | 867 ± 164 | 1349 ± 224 | 41% |

TABLE 26-continued

| | | Results | | | |
|---|---|---|---|---|---|
| 9*** | API buffer* + 2 mg/kg α-PD-1 | 817 ± 74 | 1150 ± 132 | 1875 ± 221 | 16% |
| 10*** | 1 mg/kg PEGPH20* + 2 mg/kg α-PD-1 | 566 ± 61 | 772 ± 108 | 1132 ± 158 | 52% |

*API buffer or PEGPH20 was administered 24 hours prior to dose of anti-PD-1 or isotype control.
**Treatment delayed until tumor size average was approximately 300 mm$^3$ (day 3 of study).
***Treatment delayed until tumor size average was approximately 400 mm$^3$ (day 7 of study).

Example 10

Effect of Anti-PD-1 Antibody and Pre-Administered Dexamethasone in Syngeneic MH194+PSC4 Tumor Mouse Model Mice containing parental MH194+PSC4 syngeneic tumors generated as described in Example 1C, with a mean tumor volume of 131±26 mm$^3$, were randomized into treatment groups, each containing 6 mice, such that the mean tumor volume of each group were substantially the same. Dexamethasone or saline (0.9% sodium chloride for injection) were administered intraperitoneally (IP) on days 0, 3, 7, 10, 14, and 17, and anti-PD-1 (BioXCell Inc, clone RMP1-14, Cat. No. BE0146) or saline were administered intraperitoneally (IP) on days 1, 4, 8, 11, 15, and 18, all at the dose levels indicated in Table 27. Tumor volumes were measured on days 0, 3, 7, 10, 14, 17, and 21. The middle dexamethasone dose level (3 mg/kg) was selected to approximate the human dose equivalent for clinical trials in which PEGPH20 is administered with dexamethasone to alleviate musculoskeletal discomfort.

TABLE 27

Dexamethasone and anti-PD-1 Treatment Conditions

| Group | n | Treatment 1 | Dexamethasone dose (mg/kg) | Treatment 2 | IG dose (mg/kg) |
|---|---|---|---|---|---|
| 1 | 6 | Saline | 0* | Saline | 0 |
| 2 | 6 | Saline | 0* | anti-PD-1 | 4 |
| 3 | 6 | Dexamethasone | 1* | Saline | 0 |
| 4 | 6 | Dexamethasone | 3* | Saline | 0 |
| 5 | 6 | Dexamethasone | 5* | Saline | 0 |
| 6 | 6 | Dexamethasone | 1* | anti-PD-1 | 4 |
| 7 | 6 | Dexamethasone | 3* | anti-PD-1 | 4 |
| 8 | 6 | Dexamethasone | 5* | anti-PD-1 | 4 |

*Dexamethasone or saline control was administered 24 hours prior to dose of anti-PD-1.

The results are presented in Table 28 Tumor growth inhibition (TGI) was calculated using the following formula: 1-(tumor volume, test article$_{(last\ day)}$-tumor volume test article$_{(baseline\ measurement)}$)/(tumor volume, vehicle$_{(last\ day)}$-tumor volume, vehicle$_{(baseline\ measurement)}$)×100%. The results showed that the growth of tumors in animals treated with anti-PD-1 at 4 mg/kg (Group 2) was inhibited by roughly ⅔ (p<0.0001), whereas dexamethasone significantly inhibited tumor growth only at the highest dose tested, 5 mg/kg (p=0.0009). Administration of dexamethasone at doses ranging from 1 to 5 mg/kg 24 h prior to 4 mg/kg of anti-PD-1 (Group 4) did not alter the effect of anti-PD-1 (p=0.12, 0.65, and 0.70, respectively, for dexamethasone at 1, 3 and 5 mg/kg plus anti-PD-1 vs anti-PD-1 alone).

TABLE 28

| | | Results | | | |
|---|---|---|---|---|---|
| | | Tumor volume (mm$^3$), Mean ± SEM | | | |
| Group | Treatment | Day 0 | Day 3 | Day 7 | Day 10 |
| 1 | Saline* + Saline | 135 ± 17 | 307 ± 36 | 449 ± 63 | 596 ± 72 |
| 2 | Saline* + 4 mg/kg α-PD-1 | 132 ± 10 | 340 ± 41 | 361 ± 56 | 316 ± 54 |
| 3 | 1 mg/kg Dex* + Saline | 133 ± 8 | 240 ± 19 | 374 ± 39 | 581 ± 50 |
| 4 | 3 mg/kg Dex* + Saline | 133 ± 9 | 253 ± 17 | 436 ± 23 | 553 ± 63 |
| 5 | 5 mg/kg Dex* + Saline | 125 ± 10 | 251 ± 22 | 390 ± 46 | 462 ± 46 |
| 6 | 1 mg/kg Dex* + 4 mg/kg α-PD-1 | 126 ± 10 | 253 ± 38 | 283 ± 51 | 203 ± 45 |
| 7 | 3 mg/kg Dex* + 4 mg/kg α-PD-1 | 134 ± 10 | 218 ± 26 | 342 ± 59 | 350 ± 86 |
| 8 | 5 mg/kg Dex* + 4 mg/kg α-PD-1 | 135 ± 13 | 277 ± 36 | 345 ± 41 | 320 ± 75 |

TABLE 28-continued

Results

| | | Tumor volume (mm³), Mean ± SEM | | | |
|---|---|---|---|---|---|
| Group | Treatment | Day 14 | Day 17 | Day 21 | TGI |
| 1 | Saline* + Saline | 981 ± 169 | 1431 ± 135 | 2316 ± 247 | — |
| 2 | Saline* + 4 mg/kg α-PD-1 | 384 ± 80 | 574 ± 159 | 840 ± 270 | 68% |
| 3 | 1 mg/kg Dex* + Saline | 904 ± 81 | 1354 ± 147 | 1899 ± 155 | 19% |
| 4 | 3 mg/kg Dex* + Saline | 759 ± 81 | 1346 ± 109 | 1867 ± 130 | 21% |
| 5 | 5 mg/kg Dex* + Saline | 729 ± 77 | 1202 ± 118 | 1630 ± 126 | 31% |
| 6 | 1 mg/kg Dex* + 4 mg/kg α-PD-1 | 231 ± 59 | 271 ± 127 | 319 ± 155 | 91% |
| 7 | 3 mg/kg Dex* + 4 mg/kg α-PD-1 | 348 ± 90 | 468 ± 196 | 642 ± 277 | 77% |
| 8 | 5 mg/kg Dex* + 4 mg/kg α-PD-1 | 364 ± 107 | 493 ± 197 | 659 ± 247 | 76% |

*Dexamethasone (Dex) or saline was administered 24 hours prior to dose of anti-PD-1 or saline.

Example 11

Generation of Alexa Fluor 488 (AF488)-Labeled Anti-Human CTLA4, PD-1, and PD-L1 Antibodies Alexa Fluor 488 (AF488) protein labeling kit (Life Technologies, Cat #A-10235) was used for labeling anti-human PD-L1 antibody (G&P Biosciences, Cat. No. MAB0199), anti-human PD-1 antibody (G&P Biosciences, Cat. No. MAB1732), and anti-human CTLA4 antibody (G&P Biosciences, Cat. No. MAB1718).

Labeling was performed according to the manufacturer's instructions. A 1 M solution of sodium bicarbonate was prepared, and 100 μL of the prepared solution were added to 1 mL of 1 mg/mL antibody (total 1 mg antibody). This mixture was added to one tube of AF488 reactive dye, supplied by the manufacture. The reaction mixture was incubated for 1 hour at room temperature with gentle rocking.

AF488 labeled anti-human antibodies, designated as AF488-anti-PD-L1, AF488-anti-PD-1, and AF488-anti-CTLA4, and as a group designated as AF488-antibody, was separated using Bio-Rad micro Bio-spin 6 columns (Bio-Rad, Cat #732-6621). Total protein concentration was determined by Pierce BCA protein assay kit (Pierce, Cat #23227).

Example 12

Effect of Hyaluronidase on Anti-Human PD-L1, Anti-Human CTLA4, and Anti-Human PD-1: Accessibility to HA-High Xenograft Tumor Mouse Model Mice bearing HA-high SKOV3/HAS2 xenograft tumors were generated as described in Example 2, and were treated with PEGPH20 described in Example 5 alone and in combination with AF488-anti-PD-L1, -PD-1, or -CTLA4 (described in Example 9) as follows:

Mice containing HA-high xenograft tumors, with a mean tumor volume of 500 mm³, were randomized into treatment groups, each containing 4 mice, such that the mean tumor volume of each group was substantially the same. Treatments were administered once as set forth in Table 29 below. AF488-antibody as described in Example 7 or Active Pharmaceutical Ingredient (API) buffer (10 mM histidine, 130 mM NaCl, pH 6.5) or PEGPH20 (described in Example 5) and AF488-antibody were administered intravenously (IV), all at the dose levels indicated. Tumors were harvested 48 h post treatment and imaged using a Bio-Rad Chemidoc MP Imaging System (Bio-Rad).

TABLE 29

PEGPH20 and anti-human PD-L1 Treatment Conditions

| Group | n | Treatment 1 | PEGPH20 dose (mg/kg) | Treatment 2 | IG dose (mg/kg) |
|---|---|---|---|---|---|
| 1 | 4 | API buffer | 0 | Saline | 0 |
| 2 | 4 | API buffer | 0 | AF488-anti-PD-L1 | 1 |
| 3 | 4 | PEGPH20 | 0.0375 | AF488-anti-PD-L1 | 1 |
| 4 | 5 | API buffer | 0 | AF488-anti-PD-1 | 1 |
| 5 | 5 | PEGPH20 | 0.0375 | AF488-anti-PD-1 | 1 |
| 6 | 5 | API buffer | 0 | AF488-anti-CTLA4 | 1 |
| 7 | 5 | PEGPH20 | 0.0375 | AF488-anti-CTLA4 | 1 |

The results are presented in Table 30 (positive pixel count) and Table 31 (mean fluorescence intensity). Pixel counts and fluorescence intensity means were obtained using Image Pro (MediaCybernetics Image Pro Analyzer 7.0) software, and the average background from tumors in animals not injected with AF488-antibody was subtracted. Results showed that fluorescence was detectable in the tumors in animals administered either AF488-antibody alone (Groups 2, 4, and 6). Fluorescence intensity increased significantly in the tumors in animals treated with the combination of PEGPH20 and AF488-anti-PD-L1 (Group 3). On the other hand, no increase in fluorescence intensity was observed in animals treated with PEGPH20 and AF488-anti-PD-1 or AF488-anti-CTLA4, when compared to the animals treated only with AF488-PD-1 or -CTLA4, in the absence of PEGPH20 (Groups 5 and 7). Thus, the results show that the combinatorial treatment of PEGPH20 and anti-human PD-L1 increased anti-PD-L1 accessibility to the HA-high tumors in a manner specific to anti-PD-L1.

TABLE 30

Results: Positive Pixel Count

| Group | Treatment 1 | Positive Pixel Count; mean ± SEM |
|---|---|---|
| 1 | API buffer | 0 |
| 2 | AF488-anti-PD-L1 | 320 ± 44 |
| 3 | PEGPH20 + AF488-anti-PD-L1 | 884 ± 123 |
| 4 | AF488-anti-PD-1 | 1014 ± 80 |
| 5 | PEGPH20 + AF488-anti-PD-1 | 877 ± 73 |
| 6 | AF488-anti-CTLA4 | 607 ± 86 |
| 7 | PEGPH20 + AF488-anti-CTLA4 | 719 ± 121 |

TABLE 31

Results - Mean Fluorescence Intensity

| Group | Treatment 1 | Fluorescence Intensity; mean ± SIM |
|---|---|---|
| 1 | API buffer | 0 |
| 2 | AF488-anti-PD-L1 | 5,847 ± 1,306 |
| 3 | PEGPH20 + AF488-anti-PD-L1 | 15,074 ± 1,817 |
| 4 | AF488-anti-PD-1 | 5,128 ± 797 |
| 5 | PEGPH20 + AF488-anti-PD-1 | 4,177 ± 981 |
| 6 | AF488-anti-CTLA4 | 7,384 ± 1,019 |
| 7 | PEGPH20 + AF488-anti-CTLA4 | 7,645 ± 1,847 |

Example 13

Multivesicular Liposome (MVL) PH20 Formulations

For systemic administration, hyaluronidases, including soluble hyaluronidases, can be prepared in lipids vesicles, such as liposomes. Exemplary of these are multivesicular liposomes (MVL). Various extended release multivesicular liposome PH20 (MVL-PH20) formulations were prepared using the following general procedure, also see published International PCT Application No. WO 2012/109387 and US Publication US-2013-0251786-A1. The lipid solutions contained mixtures of various neutral lipids, including triglycerides (TG) triolein ($C_{18:1}$), tricaprylin ($C_{8:0}$) and cholesterol, and lipids with both positive and negative charges, including phosphatidylcholines (PC), dioleoylphosphatidylcholine (DOPC, $C_{18:1}$), dierucoyl phosphatidylcholine (DEPC, $C_{22:1}$) and dipalmitoyl phosphorylglycerol (DPPG, $C_{16:1}$). Total PC concentration was up to 19.8 mM, cholesterol concentration was 30 mM, TG concentration was up to 3.9 mM and DPPG concentration was 4.2 mM.

A. Generation of MVL-PH20 Formulations

MVL formulations containing varying mole percent of DEPC and DOPC (0-100%) and varying mole percent of triolein and tricaprylin (0-100%), DPPG, cholesterol, and 0.1, 0.25, 0.5, 1 or 2 mg/mL PH20 were prepared. In the first step, the lipids in chloroform (oil phase) and PH20 in a first aqueous solution (water phase) were combined and emulsified to form a water-in-oil emulsion, whereby the PH20 was encapsulated by the phospholipid monolayer. In the second step, a second aqueous solution was added and emulsified, whereby a water-in-oil-in-water emulsion was formed. After addition of a second aliquot of the second aqueous solution, the chloroform solvent was evaporated and the resulting product containing multivesicular liposomes was washed multiple times in a third aqueous solution and resuspended to approximately 50% lipocrit (packed particle volume) and stored at 2-8° C.

Exemplary formulations were prepared using either a mini vortex or were prepared on a larger scale using an Omni mixer (Omni Macro ES, Omni International, Kennesaw, Ga.). In the latter Omni mixer method, the lipid solution in chloroform (6 mL) was emulsified at 7,000 rpm for 8 min with an Omni Mixer with 6 mL of the first aqueous solution (10 mM His-HCl, pH 6.5 with 5% sucrose containing varying concentrations of PH20) producing a water-in-oil emulsion. A subsequent emulsification at 4500 rpm for 1-3 min with 20 mL of a second aqueous solution of 3.2% glucose containing 40 mM lysine, pH 10.0, resulted in a water-in-oil-in-water second emulsion. The second emulsion was transferred equally into two Erlenmeyer flasks and another 50 mL aliquot of the second aqueous solution was added to both flasks. Chloroform was removed by flushing nitrogen over the surface of the emulsion at 35° C. The MVL particles containing PH20 were washed three times with 50 mL third aqueous solution (25 mM His-HCl buffer, pH 6.0 containing 120 mM NaCl) by adding the solution, mixing the centrifuge tube by inversion, and centrifugation at 3500 rpm for 10 min at 4° C. in a refrigerated table top centrifuge. Finally, the MVL particles were resuspended in the third aqueous solution to form an approximately 50% lipocrit formulation and stored refrigerated at 2-8° C. The mini vortex procedure was similar, using the parameters set forth in Table 30.

Table 32 below summarizes the first, second and third aqueous solutions. Table 32 also summarizes the volumes, reagent concentrations and other parameters of each step of the MVL process.

TABLE 32

| MVL-PH20 formulation and process parameters | | |
|---|---|---|
| 1st Aqueous Solution | 10 mM His-HCl, pH 6.5 with 5% sucrose | |
| 2nd Aqueous Solution | 3.2% glucose containing 40 mM lysine, pH 10.0 | |
| 3rd Aqueous Solution | 25 mM His-HCl buffer, pH 6.0 containing 120 mM NaCl | |
| | Vortex Mixer | Omni Mixer |
| 1st Emulsion Mixing | | |
| PH20 in 1st aqueous solution | 600 μL | 6 mL |
| Lipid Solution in chloroform | 600 μL | 6 mL |
| Total Volume | 1.2 mL | 12 mL |
| 1st Emulsification Speed | Maximum RPM | 7000 RPM |
| Time | 8 min | 8 min |

TABLE 32-continued

| MVL-PH20 formulation and process parameters | | |
| --- | --- | --- |
| Starting PH20 protein concentration (activity) | 0.25 mg/mL (30,000 U/mL)    0.5 mg/mL (60,000 U/mL)    0.5 mg/mL (60,000 U/mL) | 1.0 mg/mL (120,000 U/mL)    2.0 mg/mL (240,000 U/mL) |
| PC | 15.8-19.8 mM | 15.8-19.8 mM |
| Cholesterol | 30 mM | 30 mM |
| TG | 3.75-3.9 mM | 3.75-3.9 mM |
| DPPG | 4.2 mM | 4.2 mM |
| Blade Type 1 | Not applicable | Sharp on the sides |
| Blade Type 2 | Not applicable | Sharp on the sides and on the inside |
| Blade Type 3 | Not applicable | Flat all over, not sharp |
| $2^{nd}$ Emulsion Mixing | | |
| 2nd Aqueous Solution | 2.5 mL | 20 mL |
| Total Volume | 3.7 mL | 32 mL |
| Speed | Maximum RPM | 4500 RPM |
| Time | 15 sec | 1-3 min |
| Solvent Evaporation | | |
| 2nd Aqueous Solution | 10 mL | 100 mL |
| Total Volume | 13.7 mL | 132 mL |
| Shaking Water Bath Speed | 100-130 RPM | 100-130 RPM |
| Time | 11 min | 15 min |
| Temperature | 35° C. | 35° C. |
| Washing, buffer exchange and resuspension | | |
| Sample | Entire Sample | 17 mL |
| 3rd Aqueous Solution | 50 mL | 50 mL |
| Total Volume | 50 mL | 200 mL |
| Centrifugation Speed | 3500 RPM | 3500 RPM |
| Time | 10 min | 10 min |
| Number of Washes | 3 | 3 |
| Resuspension Volume | 0.3-0.5 mL | 3-5 mL |
| LIPOCRIT | | |
| Pellet volume | Varies | Varies |
| 3rd Aqueous Solution | Varies | Varies |
| Speed | 3500 rpm | 3500 rpm |
| Time (min) | 10 min | 10 min |
| Solution + Pellet Volume | Varies | Varies |
| % Lipocrit Adjusted to | ~50% | ~50% |

B. Summary of Exemplary MVL-PH20 Formulations

Several MVL-PH20 formulations containing varying molar ratios of lipids, PH20 and other additives were prepared using the same general procedures as described above. The various additional additives were included in the $1^{st}$ aqueous solution to enhance and preserve the stability of encapsulated PH20. For example, formulations F68 and F69 contained calcium chloride. Formulation F82 contained 150 µL glycerol as an interphase separating the 600 µL chloroform phase and 600 µL first aqueous solution phase. Formulation F83 contained 0.1% dextran 40,000 and 0.1% PEG-6000. Formulations F85-F87 contained hyaluronic acid (HA) oligomers. Several formulations varied in their mixing/emulsification procedures. For example, for formulation F66, the first emulsification step was carried out for 4 minutes, instead of 8 minutes, resulting in smaller liposomal pellets. Formulation F67 was mixed with a rotor wheel, instead of a mini vortex to generate lesser shear during mixing.

Table 33 below sets forth various MVL-PH20 formulations, including the formulation number, the formulation PC (phosphatidylcholine) and TG (triglyceride) molar % ratios, the starting concentration of PH20 in mg/mL, the mixer used for making the emulsions, and any additives that were included in the first aqueous solution.

TABLE 33

| | MVL Formulations with PH20 | | | |
| --- | --- | --- | --- | --- |
| Formulation | Formulation PC & TG mol % ratio | Starting PH20 concentration mg/mL | Mixer | Additives in First Aqueous Solution |
| F40 | DEPC with Triolein | 0.25 | Mini Vortex | N/A |
| F41 | DEPC with Triolein | 0 | Mini Vortex | N/A |

TABLE 33-continued

| | MVL Formulations with PH20 | | | |
|---|---|---|---|---|
| Formulation | Formulation PC & TG mol % ratio | Starting PH20 concentration mg/mL | Mixer | Additives in First Aqueous Solution |
| F42 | DEPC with Triolein | 0.25 fluorescent labeled | Mini Vortex | AlexaFluor 488 labeled PH20 |
| F53 | 25/75 DEPC/DOPC; 25/75 Triolein/Tricap | 0.25 | Mini Vortex | N/A |
| F54 | 50/50 DEPC/DOPC; 50/50 Triolein/Tricap | 0.25 | Mini Vortex | N/A |
| F55 | 75/25 DEPC/DOPC; 75/25 Triolein/Tricap | 0.25 | Mini Vortex | N/A |
| F56 | 90/10 DEPC/DOPC; 90/10 Triolein/Tricap | 0.25 | Mini Vortex | N/A |
| F61 | 50/50 DEPC/DOPC; 50/50 Triolein/Tricap | 0.25 | Omni | N/A |
| F66 | 50/50 DEPC/DOPC; 50/50 Triolein/Tricap | 0.25 | Mini Vortex[1] | N/A |
| F67 | 50/50 DEPC/DOPC; 50/50 Triolein/Tricap | 0.25 | Rotor Wheel | N/A |
| F68 | 50/50 DEPC/DOPC; 50/50 Triolein/Tricap | 0.25 | Mini Vortex | 20 mM $CaCl_2$ |
| F69 | 50/50 DEPC/DOPC; 50/50 Triolein/Tricap | 0.25 | Mini Vortex | 10 mM $CaCl_2$ |
| F70 | 50/50 DEPC/DOPC; 50/50 Triolein/Tricap | 0.0 | Omni | N/A |
| F71 | 50/50 DEPC/DOPC; 50/50 Triolein/Tricap | 0.25 | Omni | N/A |
| F72 | 50/50 DEPC/DOPC; 50/50 Triolein/Tricap | 0.5 | Omni | N/A |
| F73 | 50/50 DEPC/DOPC; 50/50 Triolein/Tricap | 0.5 | Omni | N/A |
| F74 | 50/50 DEPC/DOPC; 50/50 Triolein/Tricap | 1.0 | Omni | N/A |
| F75 | 50/50 DEPC/DOPC; 50/50 Triolein/Tricap | 2.0 | Omni | N/A |
| F77[2] | 50/50 DEPC/DOPC; 50/50 Triolein/Tricap | 1.0 | Omni | |
| F78 | DEPC with Triolein | 1.0 | Omni | N/A |
| F79 | DEPC with Triolein | 1.0 | Omni | N/A |
| F80 | 50/50 DEPC/DOPC; 50/50 Triolein/Tricap | 1.0 | Omni | N/A |
| F81 | DEPC with Triolein | 0.5 | Omni | N/A |
| F82 | 50/50 DEPC/DOPC; 50/50 Triolein/Tricap | 0.5 | Mini Vortex | 150 µL Glycerol as interphase |
| F83 | 50/50 DEPC/DOPC; 50/50 Triolein/Tricap | 1.0 | Omni | 0.1% Dextran 40,000 0.1% PEG-6000 |
| F84 | 50/50 DEPC/DOPC; 50/50 Triolein/Tricap | 1.0 | Omni[3] | N/A |
| F85 | 50/50 DEPC/DOPC; 50/50 Triolein/Tricap | 1.0 | Omni | 15 mg/mL HA 74,000 |
| F85R1 | 50/50 DEPC/DOPC; 50/50 Triolein/Tricap | 1.0 | Omni | 15 mg/mL HA 74,000 |
| F86 | 50/50 DEPC/DOPC; 50/50 Triolein/Tricap | 1.0 | Omni | 50 mg/mL HA 74,000 |
| F87 | 50/50 DEPC/DOPC; 50/50 Triolein/Tricap | 1.0 | Omni | 100 mM Proline |
| F88 | 50/50 DEPC/DOPC; 50/50 Triolein/Tricap | 1.0 | Omni | 100 mM Arg-HCl, pH 6.44 |
| F89 | 50/50 DEPC/DOPC; 50/50 Triolein/Tricap | 1.0 | Omni | 6% Sorbitol |
| F90 | 50/50 DEPC/DOPC; 50/50 Triolein/Tricap | 1.0 | Omni | 6% Trehalose |

[1]Shorter first emulsion mixing time (4 min)
[2]Animal derived cholesterol used instead of plant derived cholesterol in the lipid solution
[3]Shorter first emulsion mixing time (4 min) and shorter second emulsion mixing time (30 sec)

SEQUENCE LISTING (320 sequences)

SEQ ID NO: 1 - DNA, 10836 bp, Artificial Sequence
  pLV-EF1a-hHAS3-IRES-Hyg
aagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgatgcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgatatcctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctctagacccgggccaccatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctgtttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtagacgcgtctccggcctagggataacagggtaatccgctagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacactagagatccaccggtcgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataggcggccgcgtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgc

SEQ ID NO: 2 - DNA, 1662 bp, Homo sapiens
  human hyaluronan synthase 3 cDNA, transcript variant 1
atgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctgtttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtag

SEQ ID NO: 3 - DNA, 9197 bp, Artificial Sequence
  pLV-EF1a-MCS-IRES-Hyg
aagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgatgcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgatatcctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctctagataatacgactcactatagggcccgggttggatccacgcgtctccggcctagggataacagggtaatccgctagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacactagagatccaccggtcgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataggcggccgcgtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgc

SEQ ID NO: 4 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 5 - DNA, 1446 bp, Homo sapiens
  DNA encoding soluble human PH20 precursor
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 6 - protein, 509 aa, Homo sapiens
  precursor full-length human PH20 protein 1-509
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 7 - protein, 482 aa, Homo sapiens
  precursor soluble human PH20, amino acid residues 1-482
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 8 - protein, 186 aa, Mus musculus
  mouse dihydrofolate reductase protein
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 9 - DNA, 1449 bp, Homo sapiens
  PH20 mRNA sequence from 3D35M cells (contains c to a at base 1131)
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 10 - protein, 223 aa, Homo sapiens
  CTLA4
  ref <308>: DATABASE ACCESSION NUMBER: GenBank: AAL07473.1
  ref <309>: DATABASE ENTRY DATE: 2001-09-26
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 11 - DNA, 123 bp, Artificial Sequence
  CTLA-4 binding aptamer M9a-1
gggggaattctaatacgactcactatagggagagaggaagagggataggccgcccgagtacaaacgtactcgcctgtttgcccaaccgacataacccagaggtcgatagtacyggatcccccc

SEQ ID NO: 12 - DNA, 40 bp, Unknown
  CTLA-4 binding aptamer M9a-4
cagccaaaggatatccaagcggcacgccataacacaacac

SEQ ID NO: 13 - DNA, 41 bp, Artificial Sequence
  CTLA-4 binding aptamer M9a-5
caccggaagggctacactcctatatcccctgcccagcccgc

SEQ ID NO: 14 - DNA, 40 bp, Artificial Sequence
  CTLA-4 binding aptamer M9a-8
accacagcctttatccaagcgggtgagccccgtgaacaat

SEQ ID NO: 15 - DNA, 40 bp, Artificial Sequence
  CTLA-4 binding aptamer M9a-9
ccgacgtgccgcaacttcaaccctgcacaaccaatccgcc

SEQ ID NO: 16 - DNA, 40 bp, Artificial Sequence
  CTLA-4 binding aptamer M9a-14
caacgaaaggtgctccactaagaatggaacttctgcgatc

SEQ ID NO: 17 - DNA, 40 bp, Artificial Sequence
  CTLA-4 binding aptamer M9a-15
gtgctcaatcacgaacccgctcgacttcttctcccaagcc

SEQ ID NO: 18 - DNA, 40 bp, Artificial Sequence
  CTLA-4 binding aptamer M9a-18
tgctccaacactcacttcggaaccacctgcattccgctct

SEQ ID NO: 19 - protein, 10 aa, Artificial Sequence
  c-myc
EQKLISEEDL

SEQ ID NO: 20 - protein, 8 aa, Artificial Sequence
  FLAG tag
DYKDDDDK

SEQ ID NO: 21 - DNA, 355 bp, Homo sapiens
  Ipilimumab heavy chain varible domain (VH)
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaaacaataaatactacgcagactccgtgaagggccgattcaccatctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 22 - protein, 118 aa, Homo sapiens
  Ipilimumab heavy chain varible domain (VH)
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 23 - DNA, 325 bp, Homo sapiens
  Ipilimumab light chain varible domain (VH)
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcattcagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 24 - protein, 108 aa, Homo sapiens
  Ipilimumab light chain varible domain (VH)
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 25 - protein, 5 aa, Homo sapiens
  Ipilimumab VH CDR1
SYTMH

SEQ ID NO: 26 - protein, 17 aa, Homo sapiens
  Ipilimumab VH CDR2
FISYDGNNKYYADSVKG

SEQ ID NO: 27 - protein, 9 aa, Homo sapiens
  Ipilimumab VH CDR3
TGWLGPFDY

SEQ ID NO: 28 - protein, 12 aa, Homo sapiens
  Ipilimumab VL CDR1
RASQSVGSSYLA

SEQ ID NO: 29 - protein, 7 aa, Homo sapiens
  Ipilimumab VL CDR2
GAFSRAT

SEQ ID NO: 30 - protein, 9 aa, Homo sapiens
  Ipilimumab VL CDR3
QQYGSSPWT

SEQ ID NO: 31 - protein, 6 aa, Artificial Sequence
  His Tag
HHHHHH

SEQ ID NO: 32 - protein, 9 aa, Artificial Sequence
  HA Tag
YPYDVPDYA

SEQ ID NO: 33 - DNA, 500 bp, Homo sapiens
  Tremelimumab heavy chain varible domain (VH)
ggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccgaggggagctaccctttactactactactacgggatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgca

SEQ ID NO: 34 - protein, 167 aa, Homo sapiens
  Tremelimumab heavy chain varible domain (VH)
GVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVH

SEQ ID NO: 35 - DNA, 417 bp, Homo sapiens
  Tremelimumab light chain varible domain (VH)
ccatcctccctgtctgcatctgtaggagacagagtcaccatcacttgccgggcaagtcagagcattaacagctatttagattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagtattacagtactccattcactttcggccctgggaccaaagtggaaatcaaacgaactgtggctgcaccatctgtcttcatcttcccgccatctgatgagcagttgaaatctggaactgcctctgttgtgtgcctgctgaataacttctatcccagagaggccaaagta

SEQ ID NO: 36 - protein, 139 aa, Homo sapiens
  Tremelimumab light chain varible domain (VH)
PSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKV

SEQ ID NO: 37 - protein, 5 aa, Artificial Sequence
  (-G4S-)1 Linker
GGGGS

SEQ ID NO: 38 - protein, 10 aa, Artificial Sequence
  (-G4S-)2 Linker
GGGGSGGGGS

SEQ ID NO: 39 - protein, 15 aa, Artificial Sequence
  (Gly4Ser)3 Linker
GGGGSGGGGSGGGGS

SEQ ID NO: 40 - protein, 20 aa, Artificial Sequence
  (-G4S-)4 Linker
GGGGSGGGGSGGGGSGGGGS

SEQ ID NO: 41 - protein, 25 aa, Artificial Sequence
  (-G4S-)5 Linker
GGGGSGGGGSGGGGSGGGGSGGGGS

SEQ ID NO: 42 - protein, 11 aa, Artificial Sequence
  VSV-G
YTDIEMNRLGK

SEQ ID NO: 43 - protein, 11 aa, Artificial Sequence
  HSV
QPELAPEDPED

SEQ ID NO: 44 - protein, 14 aa, Artificial Sequence
  V5
GKPIPNPLLGLDST

SEQ ID NO: 45 - protein, 5 aa, Artificial Sequence
  Poly Arg Tag
RRRRR

SEQ ID NO: 46 - protein, 8 aa, Artificial Sequence
  Strep-tag-II
WSHPQFEK

SEQ ID NO: 47 - protein, 15 aa, Artificial Sequence
  S Epitope Tag
KETAAAKFERQHMDS

SEQ ID NO: 48 - protein, 22 aa, Artificial Sequence
  3x FLAG Tag
DYKDHDGDYKDHDIDYKDDDDK

SEQ ID NO: 49 - protein, 19 aa, Artificial Sequence
  HAT Tag
KDHLIHNVHKEFHAHAHNK

SEQ ID NO: 50 - protein, 38 aa, Artificial Sequence
  SBP Tag
MDEKTTGWRGGHVVEGLAGELEQLRARLEHHPQGQREP

SEQ ID NO: 51 - DNA, 2116 bp, Homo sapiens
  HAS1
cggagagaagagagagcccggccagacccactgcgatgagacagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttcaaaaaaaaaaaaaaaaaaaaaaaaaaaaa

SEQ ID NO: 52 - DNA, 3275 bp, Homo sapiens
  HAS2
gaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtt

SEQ ID NO: 53 - DNA, 339 bp, Homo sapiens
  Nivolumab heavy chain variable region
caggtgcagctggtggagtctgggggaggcgtggtccagcctgggaggtccctgagactcgactgtaaagcgtctggaatcaccttcagtaactctggcatgcactgggtccgccaggctccaggcaaggggctggagtgggtggcagttatttggtatgatggaagtaaaagatactatgcagactccgtgaagggccgattcaccatctccagagacaattccaagaacacgctgtttctgcaaatgaacagcctgagagccgaggacacggctgtgtattactgtgcgacaaacgacgactactggggccagggaaccctggtcaccgtctcctca

SEQ ID NO: 54 - protein, 113 aa, Unknown [sequence omitted]

SEQ ID NO: 55 - DNA, 321 bp, Unknown
  Nivolumab light chain variable region
gaaattgtgttgacacagtctccagccaccctgtctttgtctccaggggaaagagccaccctctcctgcagggccagtcagagtgttagtagttacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagtagcaactggcctcggacgttcggccaagggaccaaggtggaaatcaaa

SEQ ID NO: 56 - protein, 107 aa, Unknown [sequence omitted]

SEQ ID NO: 57 - protein, 5 aa, Unknown
  Nivolumab VH CDR1
NSGMH

SEQ ID NO: 58 - protein, 17 aa, Unknown
  Nivolumab VH CDR2
VIWYDGSKRYYADSVKG

SEQ ID NO: 59 - protein, 4 aa, Unknown
  Nivolumab VH CDR3
NDDY

SEQ ID NO: 60 - protein, 11 aa, Unknown
  Nivolumab VL CDR1
RASQSVSSYLA

SEQ ID NO: 61 - protein, 7 aa, Unknown
  Nivolumab VL CDR2
DASNRAT

SEQ ID NO: 62 - protein, 9 aa, Unknown
  Nivolumab VL CDR3
QQSSNWPRT

SEQ ID NO: 63 - DNA, 1340 bp, Unknown
  MK-3475 full-length heavy chain
aggtgcagctggtgcagtccggcgtggaggtgaagaagcctggcgcctccgtcaaggtgtcctgtaaggcctccggctacaccttcaccaactactacatgtactgggtgcggcaggccccaggccagggactggagtggatgggcggcatcaacccttccaacggcggcaccaacttcaacgagaagttcaagaaccgggtgaccctgaccaccgactcctccaccacaaccgcctacatggaactgaagtccctgcagttcgacgacaccgccgtgtactactgcgccaggcgggactaccggttcgacatgggcttcgactactggggccagggcaccaccgtgaccgtgtcctccgctagcaccaagggcccttccgtgttccctctggccccttgctcccggtccacctccgagtccaccgccgctctgggctgtctggtgaaggactacttccctgagcctgtgaccgtgagctggaactctggcgccctgacctccggcgtgcacaccttccctgccgtgctgcagtcctccggcctgtactccctgtcctccgtggtgaccgtgccttcctcctccctgggcaccaagacctacacctgcaacgtggaccacaagccttccaacaccaaggtggacaagcgggtggagtccaagtacggccctccttgccctccctgccctgcccctgagttcctgggcggaccctccgtgttcctgttccctcctaagcctaaggacaccctgatgatctcccggacccctgaggtgacctgcgtggtggtggacgtgtcccaggaagatcctgaggtccagttcaattggtacgtggatggcgtggaggtgcacaacgccaagaccaagcctcgggaggaacagttcaactccacctaccgggtggtgtctgtgctgaccgtgctgcaccaggactggctgaacggcaaggaatacaagtgcaaggtcagcaacaagggcctgccctcctccatcgagaaaaccatctccaaggccaagggccagcctcgcgagcctcaggtgtacaccctgcctcctagccaggaagagatgaccaagaatcaggtgtccctgacatgcctggtgaagggcttctacccttccgatatcgccgtggagtgggagagcaacggccagccagagaacaactacaagaccacccctcctgtgctggactccgacggctccttcttcctgtactccaggctgaccgtggacaagtcccggtggcaggaaggcaacgtcttttcctgctccgtgatgcacgaggccctgcacaaccactacacccagaagtccctgtccctgtctctgggcaag

SEQ ID NO: 64 - protein, 447 aa, Unknown
  MK-3475 full-length heavy chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 65 - DNA, 334 bp, Unknown
  MK-3475 full-length light chain
cgagatcgtgctgacccagtcccctgccaccctgtccctgagccctggcgagcgggctaccctgagctgcagagcctccaagggcgtgtccacctccggctactcctacctgcactggtatcagcagaagccaggccaggcccctcggctgctgatctacctggcctcctacctggagtccggcgtgcctgcccggttctccggctccggaagcggcaccgacttcaccctgaccatctcctccctggagcctgaggacttcgccgtgtactactgccagcactcccgggacctgcctctgacctttggcggcggaacaaaggtggagatcaag

SEQ ID NO: 66 - protein, 218 aa, Unknown
  MK-3475 full-length light chain
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - DNA, 361 bp, Unknown
  MK-3475 heavy chain variable domain
ccaggtgcagctggtgcagtccggcgtggaggtgaagaagcctggcgcctccgtcaaggtgtcctgcaaggcctccggctacaccttcaccaactactacatgtactgggtgcggcaggctcccggccagggactggagtggatgggcggcatcaacccttccaacggcggcaccaacttcaacgagaagttcaagaaccgggtgaccctgaccaccgactcctccaccaccaccgcctacatggagctgaagtccctgcagttcgacgacaccgccgtgtactactgcgccaggcgggactaccggttcgacatgggcttcgactactggggccagggcaccaccgtgaccgtgtcctcc

SEQ ID NO: 68 - protein, 120 aa, Unknown [sequence omitted]

SEQ ID NO: 69 - DNA, 333 bp, Unknown
  MK-3475 light chain variable domain
gaaattgtgttgacacagtctccagccaccctgtctttgtctccaggggaaagagccaccctctcctgcagggccagcaaaggtgtcagtacatctggctatagttatttgcactggtatcaacagaaacctggccaggctcccaggctcctcatctatcttgcatcctacctagaatctggcgtcccagccaggttcagtggtagtgggtctgggacagacttcactctcaccatcagcagcctagagcctgaagattttgcagtttattactgtcagcacagcagggaccttccgctcacgttcggcggagggaccaaagtggagatcaaa

SEQ ID NO: 70 - protein, 111 aa, Unknown [sequence omitted]

SEQ ID NO: 71 - protein, 5 aa, Unknown
  MK-3475 VH CDR1
NYYMY

SEQ ID NO: 72 - protein, 17 aa, Unknown
  MK-3475 VH CDR2
GINPSNGGTNFNEKFKN

SEQ ID NO: 73 - protein, 11 aa, Unknown
  MK-3475 VH CDR3
RDYRFDMGFDY

SEQ ID NO: 74 - protein, 15 aa, Unknown
  MK-3475 VL CDR1
RASKGVSTSGYSYLH

SEQ ID NO: 75 - protein, 7 aa, Unknown
  MK-3475 VL CDR2
LASYLES

SEQ ID NO: 76 - protein, 9 aa, Unknown
  MK-3475 VL CDR3
QHSRDLPLT

SEQ ID NO: 77 - DNA, 1401 bp, Unknown
  Pidilizumab full-length heavy chain
atggactggacctggaggatcctcttcttggtggcagcagcaacaggtgcccactcccaggtgcagctggtgcaatctgggtctgagcttaagaagcctggggcctcagtgaagatctcctgcaaggcttctggatatactttcacaaactatggaatgaactgggtgcgacaggcccctggacaagggcttcagtggatgggatggataaacaccgacagtggagagtcaacatatgctgaagagttcaagggacggtttgtcttctccttggacacctctgtcaacacggcatatctgcagatcaccagcctcacggctgaggacactggcatgtatttctgtgtgagagtcggctacgatgctttggactactggggccagggaaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 78 - protein, 466 aa, Unknown
  Pidilizumab full-length heavy chain
MDWTWRILFLVAAATGAHSQVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - DNA, 708 bp, Unknown
  Pidilizumab full-length light chain
atggacatgagggtccccgctcagctcctggggctcctgctgctctggctcccaggtgccaaatgtgaaattgtgttgacgcagtctccatcctccctgtctgcatctgtaggagacagagtcaccatcacttgcagtgccaggtcaagtgtaagttacatgcactggttccagcagaaaccagggaaagcccctaagctctggatctataggacatccaacctggcttctggggtcccatctagattcagcggcagtggatctgggacatcttactgtctcaccatcaacagcctgcagcctgaagattttgcaacttactattgccagcaaaggagtagtttcccactcacgttcggcggagggaccaagctggagatcaaacgtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 80 - protein, 235 aa, Unknown
  Pidilizumab full-length light chain
MDMRVPAQLLGLLLLWLPGAKCEIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - DNA, 421 bp, Unknown
  Pidilizumab heavy chain variable domain
atggactggacctggaggatcctcttcttggtggcagcagcaacaggtgcccactcccaggtgcagctggtgcaatctgggtctgagcttaagaagcctggggcctcagtgaagatctcctgcaaggcttctggatatactttcacaaactatggaatgaactgggtgcgacaggcccctggacaagggcttcagtggatgggatggataaacaccgacagtggagagtcaacatatgctgaagagttcaagggacggtttgtcttctccttggacacctctgtcaacacggcatatctgcagatcaccagcctcacggctgaggacactggcatgtatttctgtgtgagagtcggctacgatgctttggactactggggccagggaaccctggtcaccgtctcctcaggtgagtggatcc

SEQ ID NO: 82 - protein, 117 aa, Artificial Sequence
  Pidilizumab heavy chain variable domain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 83 - DNA, 384 bp, Artificial Sequence
  Pidilizumab light chain variable domain
atggacatgagggtccccgctcagctcctggggctcctgctgctctggctcccaggtgccaaatgtgaaattgtgttgacgcagtctccatcctccctgtctgcatctgtaggagacagagtcaccatcacttgcagtgccaggtcaagtgtaagttacatgcactggttccagcagaaaccagggaaagcccctaagctctggatctataggacatccaacctggcttctggggtcccatctagattcagcggcagtggatctgggacatcttactgtctcaccatcaacagcctgcagcctgaagattttgcaacttactattgccagcaaaggagtagtttcccactcacgttcggcggagggaccaagctggagatcaaa

SEQ ID NO: 84 - protein, 106 aa, Artificial Sequence
  Pidilizumab light chain variable domain
EIVLTQSPSSLSASVGDRVTITCSARSSVSYMHWFQQKPGKAPKLWIYRTSNLASGVPSRFSGSGSGTDYCLTINSLQPEDFATYYCQQRSSFPLTFGGGTKLEIK

SEQ ID NO: 85 - protein, 5 aa, Artificial Sequence
  Pidilizumab VH CDR1
NYGMN

SEQ ID NO: 86 - protein, 17 aa, Artificial Sequence
  Pidilizumab VH CDR2
WINTDSGESTYAEEFKG

SEQ ID NO: 87 - protein, 8 aa, Artificial Sequence
  Pidilizumab VH CDR3
VGYDALDY

SEQ ID NO: 88 - protein, 10 aa, Artificial Sequence
  Pidilizumab VL CDR1
SARSSVSYMH

SEQ ID NO: 89 - protein, 7 aa, Artificial Sequence
  Pidilizumab VL CDR2
RTSNLAS

SEQ ID NO: 90 - protein, 9 aa, Artificial Sequence
  Pidilizumab VL CDR3
QQRSSFPLT

SEQ ID NO: 91 - DNA, 369 bp, Unknown
  BMS-936559 heavy chain variable region
caggtccagctggtgcagtctggggctgaggtgaagaagcctgggtcctcggtgaaggtctcctgcaagacttctggagacaccttcagcacctatgctatcagctgggtgcgacaggcccctggacaagggcttgagtggatgggagggatcatccctatatttggtaaagcacactacgcacagaagttccagggcagagtcacgattaccgcggacgaatccacgagcacagcctacatggagctgagcagcctgagatctgaggacacggccgtgtatttttgtgcgagaaagtttcactttgtttcggggagccccttcggtatggacgtctggggccaagggaccacggtcaccgtctcctca

SEQ ID NO: 92 - protein, 123 aa, Unknown
  BMS-936559 heavy chain variable region
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 93 - DNA, 318 bp, Unknown
  BMS-936559 light chain variable region
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgacgttcggccaagggaccaaggtggaaatcaaa

SEQ ID NO: 94 - protein, 106 aa, Unknown
  BMS-936559 light chain variable region
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 95 - protein, 6 aa, Homo sapiens
  BMS-936559 VH CDR1
TYAISW

SEQ ID NO: 96 - protein, 17 aa, Homo sapiens
  BMS-936559 VH CDR2
GIIPIFGKAHYAQKFQG

SEQ ID NO: 97 - protein, 14 aa, Homo sapiens
  BMS-936559 VH CDR3
KFHFVSGSPFGMDV

SEQ ID NO: 98 - protein, 11 aa, Unknown
  BMS-936559 VL CDR1
RASQSVSSYLA

SEQ ID NO: 99 - protein, 7 aa, Unknown
  BMS-936559 VL CDR2
DASNRAT

SEQ ID NO: 100 - protein, 8 aa, Unknown
  BMS-936559 VL CDR3
QQRSNWPT

SEQ ID NO: 101 - DNA, 360 bp, Homo sapiens
  MEDI4736 heavy chain variable region
gaggtgcagctggtcgagtctggcggcggactggtgaagcctggcggctccctgagactgtcttgcgccgccagtggctttacattcagtacctactccatgaactgggtccgccaggcaccaggcaagggcctggaatgggtgtcctccatctcatccagtggcgactacatctactacgccgactccgtgaagggccggttcaccatctcccgggacaacgccaagaactccctgtatctgcagatgaactccctgagagccgaggacaccgccgtgtactactgcgccagggacctggtgacatccatggtggccttcgactactggggtcagggcactctcgtcacagtgtcctct

SEQ ID NO: 102 - protein, 120 aa, Homo sapiens
  MEDI4736 heavy chain variable region
EVQLVESGGGLVKPGGSLRLSCAASGFTFSTYSMNWVRQAPGKGLEWVSSISSSGDYIYYADSVKGRFTISRDNAKNSLYLQMNSLRAEDTAVYYCARDLVTSMVAFDYWGQGTLVTVSS

SEQ ID NO: 103 - DNA, 324 bp, Homo sapiens
  MEDI4736 light chain variable region
tcttacgagctgacccagcctccttccgtgtccgtgtctccaggacagacggccagaatcacctgttccggcgacgccctgcctcagaaatacgtgttctggtatcagcagaagtccggccaggcccctgtgctggtgatctacgaggactccaagcggccttccggcatccctgagcggttctccggctcctcttccggcaccatggccaccctgaccatctctggcgcccaggtggaggacgaggccgactactactgctactccaccgacagatccggcaaccacagagtgtttggtgggggtactaagctgaccgtgctg

SEQ ID NO: 104 - protein, 108 aa, Homo sapiens
  MEDI4736 light chain variable region
SYELTQPPSVSVSPGQTARITCSGDALPQKYVFWYQQKSGQAPVLVIYEDSKRPSGIPERFSGSSSGTMATLTISGAQVEDEADYYCYSTDRSGNHRVFGGGTKLTVL

SEQ ID NO: 105 - protein, 5 aa, Homo sapiens
  MEDI4736 VH CDR1
TYSMN

SEQ ID NO: 106 - protein, 17 aa, Homo sapiens
  MEDI4736 VH CDR2
SISSSGDYIYYADSVKG

SEQ ID NO: 107 - protein, 11 aa, Homo sapiens
  MEDI4736 VH CDR3
DLVTSMVAFDY

SEQ ID NO: 108 - protein, 11 aa, Homo sapiens
  MEDI4736 VL CDR1
SGDALPQKYVF

SEQ ID NO: 109 - protein, 7 aa, Homo sapiens
  MEDI4736 VL CDR2
EDSKRPS

SEQ ID NO: 110 - protein, 11 aa, Homo sapiens
  MEDI4736 VL CDR3
YSTDRSGNHRV

SEQ ID NO: 111 - DNA, 1446 bp, Homo Sapiens; identical to SEQ ID NO: 5
  DNA encoding soluble rHuPH20 "precursor"

SEQ ID NO: 112 - protein, 433 aa, Unknown
  MPDL3280A heavy chain full length
EVQLVESGGGLVQPGGSLRLSCAASGFTFSDSWIHWYRQAPGKGLEWYAWISPYGGSTYYADSVKGRFTISADTSKNTAYLQMNSLRAEDTAVYYCARRHWPGGFDYWGQGTLVTVSSASTGPSVFPLAPSSKSTSGGTAALGCLVKDYFPEPVTVSWNSGALTSGVHTFPAVLQSSGLYSLSSVVTVPSSSLGTQTYICNVNHPSNTKVDKKVEPKSCDTHTCPPCPAPELLGGPSVFLFPPPDTLMISRTPEVTCWVDVSHEDPEVKFNWYVDGVEVHNATKPREEQYASTYRVVSVLTVLHQDWLNGKEYKCVSNALPAPIETISKAGQPREPQVYTLPPSREEMTNQVSLTCLVGFYPSDAVEWESNGQPENNYTTPPVLDSDGSFFLYSKLTVDKSRWQQGNVFSCSVMHEALHNHYTQKSLSLSPGK

SEQ ID NO: 113 - protein, 212 aa, Unknown
  MPDL3280A light chain full length
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 114 - protein, 118 aa, Unknown
  MPDL3280A heavy chain variable region
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 115 - protein, 108 aa, Unknown
  MPDL3280A light chain variable region
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 116 - protein, 10 aa, Unknown
  MPDL3280A VH CDR1
GFTFSDSWIH

SEQ ID NO: 117 - protein, 18 aa, Unknown
  MPDL3280A VH CDR2
AWISPYGGSTYYADSVKG

SEQ ID NO: 118 - protein, 9 aa, Unknown
  MPDL3280A VH CDR3
RHWPGGFDY

SEQ ID NO: 119 - protein, 11 aa, Unknown
  MPDL3280A LH CDR1
RASQDVSTAVA

SEQ ID NO: 120 - protein, 7 aa, Unknown
  MPDL3280A LH CDR2
SASFLYS

SEQ ID NO: 121 - protein, 9 aa, Unknown
  MPDL3280A LH CDR3
QQYLYHPAT

SEQ ID NO: 122 - protein, 474 aa, Homo sapiens
  Mature PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 123 - protein, 447 aa, Homo sapiens [sequence omitted]

SEQ ID NO: 124 - protein, 446 aa, Homo sapiens
  PH20 36-481
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 125 - protein, 445 aa, Homo sapiens
  PH20 36-480
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 126 - protein, 444 aa, Homo sapiens
  PH20 36-479
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 127 - protein, 443 aa, Homo sapiens
  PH20 36-478
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 128 - protein, 442 aa, Homo sapiens
  PH20 36-477
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 129 - protein, 432 aa, Homo sapiens
  PH20 mature 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 130 - protein, 448 aa, Homo sapiens
  PH20 mature 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 131 - protein, 464 aa, Homo sapiens
  mature PH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 132 - protein, 462 aa, Homo sapiens
  PH20 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 133 - protein, 460 aa, Homo sapiens
  PH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 134 - protein, 458 aa, Homo sapiens
  PH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 135 - protein, 456 aa, Homo sapiens
  PH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 136 - protein, 454 aa, Homo sapiens
  PH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 137 - protein, 455 aa, Homo sapiens
  PH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 138 - protein, 452 aa, Homo sapiens
  PH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 139 - protein, 450 aa, Homo sapiens
  PH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 140 - protein, 449 aa, Homo sapiens
  PH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 141 - protein, 441 aa, Homo sapiens
  PH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 142 - protein, 440 aa, Homo sapiens
  PH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 143 - protein, 439 aa, Homo sapiens
  PH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 144 - protein, 438 aa, Homo sapiens
  PH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 145 - protein, 437 aa, Homo sapiens
  PH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 146 - protein, 436 aa, Homo sapiens
  PH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 147 - protein, 435 aa, Homo sapiens
  PH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 148 - protein, 434 aa, Homo sapiens
  PH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 149 - protein, 433 aa, Homo sapiens
  PH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 150 - protein, 431 aa, Homo sapiens
  PH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 151 - protein, 430 aa, Homo sapiens
  PH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 152 - protein, 465 aa, Homo sapiens
  PH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 153 - protein, 463 aa, Homo sapiens
  PH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 154 - protein, 461 aa, Homo sapiens
  PH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 155 - protein, 459 aa, Homo sapiens
  PH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 156 - protein, 457 aa, Homo sapiens
  PH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 157 - protein, 453 aa, Homo sapiens
  PH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 158 - protein, 451 aa, Homo sapiens
  PH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 159 - protein, 509 aa, Pan troglodyte
  Precursor chimpanzee PH20 XP_527873
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIVSILFLIISSVASL

SEQ ID NO: 160 - protein, 474 aa, Pan troglodyte
  mature chimpanzee PH20 XP_527873
LNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIVSILFLIISSVASL

SEQ ID NO: 161 - protein, 477 aa, Macaca mulatta
  mature Rhesus monkey PH20 EHH17639
LNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 162 - protein, 475 aa, Macaca fascicularis
  mature Cynomolgus monkey PH20 P38568.1
LNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 163 - protein, 518 aa, Bos taurus
  Mature cow PH20
LDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 164 - protein, 439 aa, Bos taurus
  mature cow PH20 AAP55713
LDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 165 - protein, 477 aa, Mus musculus
  Mature mouse PH20 NP_001073344.1
VDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 166 - protein, 477 aa, Rattus norvegicus
  Mature rat PH20 NP_446419.1
VDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 167 - protein, 510 aa, Oryctolagus cuniculus
  Mature rabbit PH20 NP_001076141.1
ANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 168 - protein, 494 aa, Cavia porcellus
  mature guinea pig PH20 NP_001166492.1
DKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 169 - protein, 540 aa, Vulpes vulpes
  Precursor Red Fox PH20
MGVLRFQNIFFRSFLGSSGTTQAVFIFLLIPRCLTQEFRAPPFIPNVSFLWGWNAPTELCAKRFNVQLDLNLFSLIGSPLKTVVGQGIAIFYADRLGYYPHINKTTGKHVNGGIPQLGSLKKHLDKAKKDISHYIETDSMGLAVIDWDSWRPNWARNWRPKHIYKEQSIDLAQQQHIHLNLTEVTQIAQADFEKAARCFMQETLKLGKFLRPNYLWGFYLYPDCYNYNYKNPNYNGSCYDIEERRNDEIDWLWKESTALFPSIYLKSKLKSSPFTALYVRNRVLEAIRVSKVKDIKHPLPIFVYARPVFTDVLLTYLTEDDLVNTIGESVSLGVSGIVMWGSLNLTENVQICTELDTYIKNKLNPYIINVTLAAKMCSQVLCQDEGVCIRKHWNSNDYLHLNPVNFAIQLERSGRYTVQGKPTLEDLQQFSKKFYCACYANTHCRERVDMTDIHTIKVCVGEDVCIDVYLNLVPSGHLPVWKGKYVTSSNIFSVMPPATGPPCVPGRDLNRCLKARFIVEDNSKTTQTGYQSIYIKNKKQ

SEQ ID NO: 170 - protein, 505 aa, Vulpes vulpes
  Mature Red Fox PH20 Q29152
QEFRAPPFIPNVSFLWGWNAPTELCAKRFNVQLDLNLFSLIGSPLKTVVGQGIAIFYADRLGYYPHINKTTGKHVNGGIPQLGSLKKHLDKAKKDISHYIETDSMGLAVIDWDSWRPNWARNWRPKHIYKEQSIDLAQQQHIHLNLTEVTQIAQADFEKAARCFMQETLKLGKFLRPNYLWGFYLYPDCYNYNYKNPNYNGSCYDIEERRNDEIDWLWKESTALFPSIYLKSKLKSSPFTALYVRNRVLEAIRVSKVKDIKHPLPIFVYARPVFTDVLLTYLTEDDLVNTIGESVSLGVSGIVMWGSLNLTENVQICTELDTYIKNKLNPYIINVTLAAKMCSQVLCQDEGVCIRKHWNSNDYLHLNPVNFAIQLERSGRYTVQGKPTLEDLQQFSKKFYCACYANTHCRERVDMTDIHTIKVCVGEDVCIDVYLNLVPSGHLPVWKGKYVTSSNIFSVMPPATGPPCVPGRDLNRCLKARFIVEDNSKTTQTGYQSIYIKNKKQ

SEQ ID NO: 171 - protein, 331 aa, Vespula vulgaris
  yellow jacket wasp hyaluronidase
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 172 - protein, 340 aa, Vespula vulgaris
  yellow jacket wasp hyaluronidase
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 173 - protein, 382 aa, Apis mellifera
  honey bee hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 174 - protein, 331 aa, Dolichovespula maculata
  white-faced hornet hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 175 - protein, 367 aa, Polistes annularis
  paper wasp hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 176 - protein, 450 aa, Bos taurus
  bovine hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 177 - protein, 553 aa, Bos taurus
  bovine (PH20 precursor)
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 178 - protein, 474 aa, Bos taurus
  precursor cow PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 179 - protein, 509 aa, Homo sapiens
  precursor PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 180 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 181 - DNA, 2105 bp, Bos taurus
  bovine PH20 DNA
ggtttatctctgttcttggtgaggagacagacagaattgactgctgtgctcatccgcgagggtaaatgtgctcagctctttatggagtagtggagacgggcagagatgacaagatgaagcaacttgcaaaacattcctaaatacgaaggaagaagaatatttaaatgtaaatcatcattattcatttttatccatcaaagtggcttcattctgtgttcatatcttgcatcaaatattaggtacaccaaagcgtgtaggagaaaaaagtgcctttcacagtcatcgctctttgtgatgagaatgctgaggcgccaccatatctcctttcggagctttgctgggtctagcggaacaccccaggcagtgttcaccttccttctgcttccgtgttgtttggctctggacttcagagcaccccctcttatttcaaacacttctttcctctgggcctggaatgccccagttgaacgttgtgttaacagaagatttcaactacctccagatctgagactcttctctgtaaaaggaagcccccagaaaagtgctaccggacaatttattacattattttatgctgatagacttggctactatcctcatatagatgaaaaaacaggcaaaaccgtattcggaggaattccccagttgggaaacttaaaaagtcatatggagaaagcaaaaaatgacattgcctattacataccaaatgacagcgtgggcttggcggtcattgactgggaaaactggaggcctacctgggcaagaaactggaaacctaaagatgtttacagggatgagtcagttgagttggttctgcaaaaaaatccgcaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataatcataaccaacctacttacaatggaaattgccctgatgtagaaaaaaggagaaatgatgatctcgagtggttgtggaaggaaagcactgcccttttcccttctgtttatttgaatatcaggttaaaatctactcaaaatgctgccttgtatgttcgtaatcgtgtccaggaagccattcggttgtctaaaatagcgagtgtcgaaagtccacttccggtttttgtatatgcccgtccagtttttactgatgggtcttcaacatatctttctcagggtgaccttgtgaattcggttggtgagatcgtttctctaggtgcctctgggattataatgtggggcagtctcaatctaagcttatctatgcaatcttgcatgaacctaggcacttacttgaacactacactgaatccttacataatcaacgtcaccctagccgccaaaatgtgcagccaagtgctttgccacaatgaaggagtgtgtacaaggaaacactggaattcaagcgactatcttcacctgaacccaatgaattttgctattcaaactggggaaggtggaaaatacacagtacctgggacagtcacacttgaagacttgcaaaagttttctgatacattttattgcagttgttatgccaacatccactgtaagaagagagttgatataaaaaatgttcatagtgttaacgtgtgtatggcagaagacatttgtatagacagccctgtgaagttacaacccagtgatcattcctccagccaggaggcatctactaccaccttcagcagtatctcaccctccactacaactgccacagtatctccatgtactcctgagaaacactcccctgagtgcctcaaagtcaggtgttcggaagtcatccccaacgtcacccaaaaggcgtgtcaaagtgttaaattgaagaacatttcctatcagtcacctattcaaaatattaaaaatcaaacaacctattaaaattaaattcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaa

SEQ ID NO: 182 - DNA, 1971 bp, Bos taurus
  bovine Hyal1 DNA
ttggtgcgcctggtgccagacttaaggaacagaatcttgctgatgcctgcacaggccctcgccctggggtcaggaagtttggagaatgaggcctttcagccttgaggtttccctacacctgccctgggctatggcagcccacttgcttcctgtctgcaccctgttcctgaacttgctcagcatgacccaaggctcccgggaccctgtggtccccaaccagcccttcactaccatctggaatgccaacaccgagtggtgtatgaagaaacacggcgtggacgtagacatcagtatctttgatgtggtgaccaacccggggcagaccttccgcggccctaacatgaccattttctacagctcccagctgggtacctacccttactatacatctgctggggagcctgtgtttggtggcctgccccagaatgccagcctgaatgcccacctggcccgcacattccaggacatcctggctgccatgcctgagcctcgcttctcagggctggcagtcattgactgggaggcatggcgcccgcgctgggccttcaactgggacaccaaggacatttaccggcagcgctcacgggcattggtacagaagcagcacccagactggctagctcctcgggtggaggccgcagctcaggaccagttcgagggggctgcagaggagtggatggcaggcaccctcaagctgggacaagcactgcgccctcagggcctctggggcttctataatttccctgagtgctacaactatgactttaaaagtcccaactatacaggccggtgtccactaaacatctgtgcccagaatgaccagctcgggtggctgtggggccagagccgtgccctctaccccagcatctacctgcctgcagcactggagggcacgaagaagacacagatgttcgtgcagcaccgtgtggctgaggcattccgtgtggcagcgggtgcgggggaccccaagctgccggtgctgccctacatgcagctcttctacgacatgactaaccactttctgcccgcggaggagctggagcacagcctgggggagagtgcagcccagggtgcagcgggagtggtgctctgggtgagctggctgagcacaagcaccaaggaatcatgccaggccatcaaggagtatgtggacacgacgctgggaccctccatcctgaatgtgaccagcggggctcgtctgtgcagtcaggtcctatgctccggccatggccgttgtgcccggcgccccagttaccccaaggcccgcctcatcctcaactccaccagtttttccatcaagcctacacctggtggtgggcccctgaccctacaaggtgccctctcgctcgaggatcggttgcggatggcagtggagttcgaatgtcgctgctaccgtgggtggagggggacacggtgtgagcagtggggcatgtggtgattggcatgggcacgcactgagtacctgatgcaagctgggcctggctaggtagggctttcccaagtccaggcagtcacaggagtcatggttacagtcagaagtccactcagccagtgtcatgagcatacaccagtgtgcacacctgcttacagaccaagatagctgcataaggacacggtgtgagcagtggggcatatgctgattggcatgggcacacactgagtacctgatgcaatctgggcctggctagggctttcccaagtccaggcagtcacaggagtcatggttaggcatccagtcacaggagtcatgtcaggcatcctgccgacagagtcaaaaatacttcctctggagacactgagtcagtcttcaaacagaagcagtcacaagcactgacattcgggacttccctggccatccagtggttaagacacggagcttccactgcagggggcacgggcagagactaagatcacgaatgctaagcggtgcggttaaacaaataacaaataaataaactgacattcactggg

SEQ ID NO: 183 - DNA, 1912 bp, Bos taurus
  bovine Hyal2 DNA
caagtcgccggcgggctgcccaaagggcaggagctggcgcgaatagcttggctagagacttaccccgggaaggagggaggccgccgacctactgggccgacggactcccacacagttcctgagctggtgcctggcaggtgacactgacttcctgcagcccccagcatgtggacaggcctgggccccgccgtcacactggccctggtgttggtggtggcatgggccacggagctgaagcccacagcaccacccatcttcacgggccggccctttgtggtcgcatgggatgtgcccacacaggactgtggcccgcgccacaagatgccattggacccaaaggacatgaaggcctttgatgttcaggcttcacctaacgagggttttgtaaatcagaacatcaccatcttctaccgtgaccggctgggcatgtatccacacttcaattcggtggggaggtcagtacatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccatttggtagccattcgccaccctgattggccaccagagcgcgtagccaaggaggcgcagtatgagtttgagttcgctgcacggcagttcatgctggagacattgcgatttgtcaaggcgtttcggcctcggcacctatggggcttctacctcttccctgactgttacaaccatgattatgtgcagaactgggagacctatacaggccgctgccctgatgttgaggtctcccgaaatgaccagctggcctggctctgggccgagagcacggccctcttcccctctgtctacttggaagagacactggcttcctccactcacggccgcaactttgtcagctttcgtgtccaggaggctcttcgcgtggctgacgtccaccatgccaaccatgcactccccgtctacgtcttcacgaggcccacctatagccgtggactcacagggcttagcgagatggatctcatctccaccattggtgagagtgctgccctgggtgcagctggcgtcatcctctggggtgacgcagggtttaccaccagcaacgagacctgccgacgcctcaaggattatctgactcggtcattggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggaactcagttgggccgaccgcaaccacctacagatgcactttcgctgccagtgctacttaggctggggcggtgagcaatgccagtgggaccgcaggcgggcagctgggggtgccagtggggcctgggctgggtcccacctcactggcctgctggcagtggcagtcctggccttcacctagactttgtaagggtctctcacccagctgccacgccagctggcctctgccacaaggggtctgtcaggcatgtaggagcctgcaaggggtggacaaaccagagtctggaggggcagagccctctgggatgcctggtaggatgtccttaccagctcccaccccctgttctaagggggaggggcagtcccctggaaggccccgtctctccctgccagagaggaagaggggcacagctgggccggggaggacctgaccctactcccctgcccctggatagtttattattattattttggggtctcttttgtaaattaaatataaaacaact

SEQ ID NO: 184 - protein, 476 aa, Ovis aries
  sheep (Ovis aries) hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 185 - protein, 114 aa, Ovis aries
  sheep (Ovis aries) PH20 partial sequence
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 186 - protein, 520 aa, Ovis aries
  sheep (Ovis aries) PH20 protein
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 187 - protein, 517 aa, Ovis aries
  sheep (Ovis aries) PH20 protein
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 188 - DNA, 1620 bp, Ovis aries
  encoding sheep PH20
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 189 - DNA, 1537 bp, Ovis aries
  encoding sheep Hyal2
gcaaatgacactgacttcctgcagcccccagcatgtggacaggcctgggccccgccgtcacactggccctggtgttggtggtggcatgggccacagagctgaagcccacagcaccacccatcttcacgggccggccctttgtggttgcatgggatgtgcccacacaggactgtggcccacgccacaagatgccattggacccaaaggacatgaaggcctttgatgtgcaggcctcacctaacgagggttttgtaaatcagaacatcaccatcttctaccgtgaccggctgggcatgtatccacacttcaactcggtggggaggtcagtccatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccagttggtggccagtcaccaccccgattggccaccagagcgcatagtcaaggaggcgcagtatgagtttgagttcgctgcacggcagttcatgctggagacactgcgatttgtcaaggcgtttcggcctcggcacctatggggcttctacctcttccctgactgttacaaccatgattatgtgcaaaactgggagacctatacaggccgctgccctgatgttgaggtctcccgaaatgaccagctgtcctggctctgggccgagagcacagccctcttcccctctgtctacctggaagagacgctggcttcctccactcacggccgcaactttgtcagctttcgtgtccaggaggctcttcgcgtggctgacgtccaccatgccaaccatgcactcccagtctacgtcttcacgaggcccacctacagccgtggactcacagggcttagcgagatggatctcatctccaccattggtgagagtgctgccctgggtgcagccggcgtcatcctctggggtgacgcagggtttaccaccagcaacgagacctgccgacgcctcaaggattatctgactcggtcactggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggagctcagttgggccgaccgcaaccacctacagacgcactttcgctgccagtgctacttaggctggggcggtgagcagtgccagtgggaccgcaggcgggcagctgggggtgccagtggggcctgggctgggtcccacctcactggcctgctggcagtggcagtcctggccttcacctggacttcgtaagggtctcacccagctgccaggccagctggcctctgccacaaggggtctgccaggcatgtagcagcccacaaggg

SEQ ID NO: 190 - DNA, 1967 bp, Ovis aries
  encoding sheep Hyaluronidase
actcctgtttatctctgttcttggtgaggagacagacagaattgactgctgtgctcatccaccaggttacagatgaagcaacttgcaaaacattcctaaatacgaaggaagaagagtatttaaacgtaaatcatcattattcatttttatccatcaaagtagcttcattctgtgttcctatcttgcatcaaatattaggtaaaccaaagtgtgtaggagaaaaaagtgcttttcatagtcatcgctctttgtgaagagaatgctaaggcgccgccatatctcctttaggagctttgttggggccagtggaacaccccaggcggcgctcgccttccttctgcttccatgttggttggctctggacttcagagcaccccctcttatttcaaacacttctttcctctgggcctggaatgccccagctgaacgttgtgttaaaatctttaaactacctccagatctgagactcttctctgtaaaaggaagcccccaaaaaagtgctacgggacaatttattacattattttatgctgatagacttggctactatcctcatatagatgaaaaaacaggcaacaccgtatatggaggaattccccagttgggaaacttaaaaaatcatttggaaaaagccaaaaaagacattgcctattatataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttccggtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttattaagaaaaaaaaaaaaaaaaaaaaaaaaaaaa

SEQ ID NO: 191 - protein, 435 aa, Sus scrofa
  pig hyalauronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 192 - protein, 419 aa, Sus scrofa
  pig hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 193 - protein, 462 aa, Mus musculus
  mouse hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 194 - protein, 473 aa, Mus musculus
  mouse hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 195 - protein, 412 aa, Mus musculus
  mouse hyaluronidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 196 - protein, 512 aa, Mus musculus
  Precursor mouse PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 197 - protein, 529 aa, Cavia porcellus
  Precursor guinea pig PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 198 - protein, 449 aa, Rattus norvegicus
  rat hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 199 - protein, 473 aa, Rattus norvegicus
  rat hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 200 - protein, 412 aa, Rattus norvegicus
  rat hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 201 - protein, 512 aa, Rattus norvegicus
  Precursor rat PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 202 - protein, 512 aa, Macaca mulatta
  Precursor Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 203 - protein, 545 aa, Oryctolagus cuniculus
  Precursor rabbit PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 204 - protein, 510 aa, Pan troglodytes
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 205 - protein, 414 aa, Pongo pygmaeus
  Orangutan hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 206 - protein, 510 aa, Macaca fascicularis
  Precursor Cynomolgus monkey PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 207 - protein, 491 aa, Homo sapiens
  PH20 precursor 1-491
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 208 - protein, 492 aa, Homo sapiens
  PH20 precursor 1-492
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 209 - protein, 493 aa, Homo sapiens
  PH20 precursor 1-493
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 210 - protein, 494 aa, Homo sapiens
  PH20 precursor 1-494
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 211 - protein, 495 aa, Homo sapiens
  PH20 precursor 1-495
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 212 - protein, 496 aa, Homo sapiens
  PH20 precursor 1-496
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 213 - protein, 497 aa, Homo sapiens
  PH20 precursor 1-497
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 214 - protein, 498 aa, Homo sapiens
  PH20 precursor 1-498
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 215 - protein, 499 aa, Homo sapiens
  PH20 precursor 1-499
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 216 - protein, 500 aa, Homo sapiens
  PH20 precursor 1-500
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 217 - protein, 509 aa, Homo sapiens; identical to SEQ ID NO: 6
  human (PH20 precursor) (1-509)

SEQ ID NO: 218 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 219 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 220 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 221 - protein, 481 aa, Homo sapiens
  Hyaluronidase-4 [Precursor]
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 222 - protein, 793 aa, Arthrobacter sp.
  Hyaluronan lyase (strain FB24)
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 223 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 224 - protein, 813 aa, Propionibacterium acnes
  Hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 225 - protein, 1072 aa, Streptococcus agalactiae
  Hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 226 - protein, 1072 aa, Streptococcus agalactiae 18RS21
  Hyaluronan lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 227 - protein, 1081 aa, Streptococcus agalactiae serotype Ia
  Hyaluronan lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 228 - protein, 984 aa, Streptococcus agalactiae serotype III
  Hyaluronan lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 229 - protein, 807 aa, Staphylococcus aureus (strain COL)
  Hyaluronan lyase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 230 - protein, 420 aa, Staphylococcus aureus (strain MRSA252)
  Hyaluronan lyase
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 231 - protein, 806 aa, Staphylococcus aureus (strain MRSA252)
  Hyaluronan lyase
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 232 - protein, 815 aa, Staphylococcus aureus (strain MSSA476)
  Hyaluronan lyase
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 233 - protein, 807 aa, Staphylococcus aureus (strain NCTC 8325); identical to SEQ ID NO: 229
  Hyaluronan lyase

SEQ ID NO: 234 - protein, 809 aa, Staphylococcus aureus (strain bovine RF122)
  Hyaluronan lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 235 - protein, 807 aa, Staphylococcus aureus (strain bovine RF122)
  Hyaluronan lyase
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 236 - protein, 807 aa, Staphylococcus aureus (strain USA300); identical to SEQ ID NO: 229
  Hyaluronan lyase

SEQ ID NO: 237 - protein, 1066 aa, Streptococcus pneumoniae
  Hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 238 - protein, 1078 aa, Streptococcus pneumoniae (strain ATCC BAA-255/R6)
  Hyaluronan lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 239 - protein, 1067 aa, Streptococcus pneumoniae serotype 2 (strain D39/N)
  Hyaluronan lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 240 - protein, 805 aa, Streptococcus pyogenes serotype M1
  Hyaluronan lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 241 - protein, 780 aa, Streptococcus pyogenes serotype M2 (strain MGAS10)
  Hyaluronan lyase
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 242 - protein, 868 aa, Streptococcus pyogenes serotype M4 (strain MGAS10)
  Hyaluronan lyase
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 243 - protein, 828 aa, Streptococcus pyogenes serotype M6
  Hyaluronan lyase
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 244 - protein, 556 aa, Streptococcus pyogenes serotype M12 (strain MGAS2)
  Hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 245 - protein, 635 aa, Streptococcus pyogenes serotype M12 (strain MGAS2)
  Hyaluronan lyase
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 246 - protein, 828 aa, Streptococcus pyogenes serotype M12 (strain MGAS9)
  Hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 247 - protein, 828 aa, Streptococcus pyogenes serotype M28
  Hyaluronan lyase
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 248 - protein, 522 aa, Streptococcus suis
  Hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 249 - protein, 1164 aa, Streptococcus suis
  Hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 250 - protein, 1164 aa, Streptococcus suis
  Hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 251 - protein, 802 aa, Vibrio fischeri (strain ATCC 700601 / ES114)
  Hyaluronan lyase
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 252 - protein, 517 aa, Synechococcus sp. (strain RCC307)
  Hyaluronan lyase
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 253 - protein, 1021 aa, Proteus vulgaris chondroitin-sulfate-ABC endolyase
  Hyaluronan lyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 254 - protein, 684 aa, Pedobacter heparinus
  chondroitin AC lyase
PALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 255 - protein, 844 aa, Victivallis vadensis ATCC BAA-548
  chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 256 - protein, 465 aa, Homo sapiens
  PH20 precursor 1-465
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 257 - protein, 466 aa, Homo sapiens
  PH20 precursor 1-466
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 258 - protein, 467 aa, Homo sapiens
  PH20 precursor 1-467
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 259 - protein, 468 aa, Homo sapiens
  PH20 precursor 1-468
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 260 - protein, 469 aa, Homo sapiens
  PH20 precursor 1-469
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 261 - protein, 470 aa, Homo sapiens
  PH20 precursor 1-470
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 262 - protein, 471 aa, Homo sapiens
  PH20 precursor 1-471
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 263 - protein, 472 aa, Homo sapiens
  PH20 precursor 1-472
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 264 - protein, 473 aa, Homo sapiens
  PH20 precursor 1-473
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 265 - protein, 474 aa, Homo sapiens
  PH20 precursor 1-474
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 266 - protein, 475 aa, Homo sapiens
  PH20 precursor 1-475
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 267 - protein, 476 aa, Homo sapiens
  PH20 precursor 1-476
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 268 - protein, 477 aa, Homo sapiens
  PH20 precursor 1-477
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 269 - protein, 478 aa, Homo sapiens
  PH20 precursor 1-478
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 270 - protein, 479 aa, Homo sapiens
  PH20 precursor 1-479
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 271 - protein, 480 aa, Homo sapiens
  PH20 precursor 1-480
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 272 - protein, 481 aa, Homo sapiens
  PH20 precursor 1-481
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 273 - protein, 482 aa, Homo sapiens; identical to SEQ ID NO: 7
  precursor PH20 1-482

SEQ ID NO: 274 - protein, 483 aa, Homo sapiens
  PH20 precursor 1-483
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 275 - protein, 484 aa, Homo sapiens
  PH20 precursor 1-484
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 276 - protein, 485 aa, Homo sapiens
  PH20 precursor 1-485
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 277 - protein, 486 aa, Homo sapiens
  PH20 precursor 1-486
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 278 - protein, 487 aa, Homo sapiens
  PH20 precursor 1-487
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 279 - protein, 488 aa, Homo sapiens
  PH20 precursor 1-488
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 280 - protein, 489 aa, Homo sapiens
  PH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 281 - protein, 490 aa, Homo sapiens
  PH20 precursor 1-490
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 282 - protein, 10 aa, Homo sapiens
  Tremelimumab VH CDR1
GFTFSSYGMH

SEQ ID NO: 283 - protein, 15 aa, Homo sapiens
  Tremelimumab VH CDR2
VIWYDGSNKYYADSV

SEQ ID NO: 284 - protein, 16 aa, Homo sapiens
  Tremelimumab VH CDR3
DPRGATLYYYYYGMDV

SEQ ID NO: 285 - protein, 11 aa, Homo sapiens
  Tremelimumab VL CDR1
RASQSINSYLD

SEQ ID NO: 286 - protein, 7 aa, Homo sapiens
  Tremelimumab VL CDR2
AASSLQS

SEQ ID NO: 287 - protein, 9 aa, Homo sapiens
  Tremelimumab VL CDR3
QQYYSTPFT

SEQ ID NO: 288 - protein, 330 aa, Homo sapiens [sequence omitted]

SEQ ID NO: 289 - protein, 330 aa, Artificial Sequence
  Cetuximab R216 heavy chain constant domain
  DOMAIN (1)...(98): CH1
  DOMAIN (99)...(113): hinge region
  DOMAIN (114)...(223): CH2
  DOMAIN (224)...(328): CH3
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 333 aa, Artificial Sequence
  Cetuximab R216 Ins222PKS heavy chain constant domain
  DOMAIN (1)...(98): CH1
  DOMAIN (99)...(116): hinge region
  DOMAIN (117)...(226): CH2
  DOMAIN (227)...(331): CH3
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 330 aa, Artificial Sequence [sequence omitted]

SEQ ID NO: 292 - protein, 330 aa, Artificial Sequence
  Cetuximab R216 E358 M360 heavy chain constant domain
  DOMAIN (1)...(98): CH1
  DOMAIN (99)...(113): hinge region
  DOMAIN (114)...(223): CH2
  DOMAIN (224)...(328): CH3
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 326 aa, Homo sapiens
  human IgG2
  DOMAIN (1)...(98): CH1
  DOMAIN (99)...(110): hinge region
  DOMAIN (111)...(219): CH2
  DOMAIN (220)...(326): CH3
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 294 - protein, 377 aa, Homo sapiens
  human IgG3
  DOMAIN (1)...(98): CH1
  DOMAIN (99)...(160): hinge region
  DOMAIN (161)...(270): CH2
  DOMAIN (271)...(376): CH3
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 295 - protein, 327 aa, Homo sapiens
  human IgG4
  DOMAIN (1)...(98): CH1
  DOMAIN (99)...(110): hinge region
  DOMAIN (111)...(220): CH2
  DOMAIN (221)...(327): CH3
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 296 - protein, 107 aa, Homo sapiens [sequence omitted]

SEQ ID NO: 297 - protein, 104 aa, Homo sapiens
  human lambda light chain constant domain
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 298 - protein, 106 aa, Homo sapiens
  Cetuximab A213 kappa light chain constant domain
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 299 - protein, 288 aa, Homo sapiens
  ref <308>: DATABASE ACCESSION NUMBER: UniProt: Q15116.3
  ref <309>: DATABASE ENTRY DATE: 2014-07-09
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 300 - protein, 371 aa, Streptococcus pyogenes bacteriophage H4489A
  hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 301 - protein, 1628 aa, Clostridium perfringens
  hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 302 - DNA, 1439 bp, Homo sapiens
  human Tumor necrosis factor-stimulated gene-6 (TSG-6) preprotein-encoding DNA GI No. 315139000
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacacaaaaaaaaaaaaaaaa

SEQ ID NO: 303 - protein, 277 aa, Homo sapiens
  human Tumor necrosis factor-stimulated gene-6 (TSG-6) preprotein
  SIGNAL (1)...(17): signal sequence
  ref <308>: DATABASE ACCESSION NUMBER: UniProt: P98066.2
  ref <309>: DATABASE ENTRY DATE: 2014-07-09
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 304 - protein, 260 aa, Homo sapiens
  mature human Tumor necrosis factor-stimulated gene-6 (TSG-6) protein
WGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 305 - protein, 93 aa, Homo sapiens
  TSG-6 Link domain
GVYHREARSGKYKLTYAEAKAVCEFEGGHLATYKQLEAARKIGFHVCAAGWMAKGRVGYPIVKPGPNCGFGKTGIIDYGIRLNRSERWDAYCY

SEQ ID NO: 306 - protein, 95 aa, Homo sapiens
  human TSG-6 aa residues 35-129
AGVYHREARSGKYKLTYAEAKAVCEFEGGHLATYKQLEAARKIGFHVCAAGWMAKGRVGYPIVKPGPNCGFGKTGIIDYGIRLNRSERWDAYCYN

SEQ ID NO: 307 - protein, 94 aa, Homo sapiens
  TSG-6 link domain aa 36-129
GVYHREARSGKYKLTYAEAKAVCEFEGGHLATYKQLEAARKIGFHVCAAGWMAKGRVGYPIVKPGPNCGFGKTGIIDYGIRLNRSERWDAYCYN

SEQ ID NO: 308 - protein, 97 aa, Homo sapiens
  TSG-6 link domain aa 36-132
GVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 309 - protein, 93 aa, Homo sapiens
  TSG-6 Link domain variant K20A/K34A/K41A
GVYHREARSGKYKLTYAEAAAVCEFEGGHLATYAQLEAARAIGFHVCAAGWMAKGRVGYPIVKPGPNCGFGKTGIIDYGIRLNRSERWDAYCY

SEQ ID NO: 310 - protein, 95 aa, Homo sapiens
  TSG-6 link domain aa 35-129 variant K21A/K35A/K42A
AGVYHREARSGKYKLTYAEAAAVCEFEGGHLATYAQLEAARAIGFHVCAAGWMAKGRVGYPIVKPGPNCGFGKTGIIDYGIRLNRSERWDAYCYN

SEQ ID NO: 311 - protein, 223 aa, Homo sapiens
  fragment of IgG1 heavy chain
TCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 312 - protein, 349 aa, Artificial Sequence
  Peptide sequence for TSG-6-LM-Fc fusion protein
MRVPAQLLGLLLLWLPGARGADIAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGS

SEQ ID NO: 313 - protein, 349 aa, Artificial Sequence
  TSG-6-LM-Fc/deltaHep (protein)
MRVPAQLLGLLLLWLPGARGADIAGVYHREARSGKYKLTYAEAAAVCEFEGGHLATYAQLEAARAIGFHVCAAGWMAKGRVGYPIVKPGPNCGFGKTGIIDYGIRLNRSERWDAYCYNTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGS

SEQ ID NO: 314 - DNA, 1059 bp, Artificial Sequence
  TSG-6-LM-Fc fusion protein - Codon optimized DNA Seq. used for protein expression
gctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcaaaggccgtgtgcgagttcgaaggcggacacctggctacatataagcagctggaggccgctcgcaaaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcc

SEQ ID NO: 315 - DNA, 1059 bp, Artificial Sequence
  TSG-6-LM-Fc/deltaHep (DNA)
gctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcagcggccgtgtgcgagttcgaaggcggacacctggctacatatgcgcagctggaggccgctcgcgcaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcc

SEQ ID NO: 316 - DNA, 1059 bp, Artificial Sequence
  TSG-6-LM-Fc fusion protein encoding DNA
gctagcatggacatgcgcgtacctgctcagttgttggggctcttgctgctgtggttgcccggggcacgtggggcagatatcgccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacaccggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaggatcc

SEQ ID NO: 317 - DNA, 1659 bp, Homo sapiens
  HAS2 cDNA
atgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatga

SEQ ID NO: 318 - protein, 434 aa, Artificial Sequence
  anti-PD-L1 antibody heavy chain
EVQLVESGGGLVQPGGSLRLSCAASGFTFSDSWIHWYRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHPSNTKVDKKVEPKSCDTHTCPPCPAPELLGGPSVFLFPPPDTLMISRTPEVTCWVDVSHEDPEVKFNWYVDGVEVHNATKPREEQYASTYRVVSVLTVLHQDWLNGKEYKCVSNALPAPIETISKAGQPREPQVYTLPPSREEMTNQVSLTCLVGFYPSDAVEWESNGQPENNYTTPPVLDSDGSFFLYSKLTVDKSRWQQGNVFSCSVMHEALHNHYTQKSLSLSPGK

SEQ ID NO: 319 - protein, 213 aa, Artificial Sequence
  anti-PD-L1 antibody light chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 320 - protein, 434 aa, Artificial Sequence
  anti-PD-L1 antibody heavy chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHPSNTKVDKKVEPKSCDTHTCPPCPAPELLGGPSVFLFPPPDTLMISRTPEVTCWVDVSHEDPEVKFNWYVDGVEVHNATKPREEQYASTYRVVSVLTVLHQDWLNGKEYKCVSNALPAPIETISKAGQPREPQVYTLPPSREEMTNQVSLTCLVGFYPSDAVEWESNGQPENNYTTPPVLDSDGSFFLYSKLTVDKSRWQQGNVFSCSVMHEALHNHYTQKSLSLSPGK

What is claimed:

1. A method for treating a cancer, comprising:
intravenously administering a first composition comprising a PEGylated soluble PH20 hyaluronidase; and
intravenously administering a second composition comprising an immune checkpoint inhibitor antibody or an antigen binding fragment thereof, wherein:
the cancer comprises a tumor that expresses hyaluronan;
the hyaluronidase is administered separately from, and at least 24 hours up to 48 hours before the immune checkpoint inhibitor antibody or an antigen binding fragment thereof; and
the immune checkpoint inhibitor antibody or antigen binding fragment thereof is an anti-CTLA-4, anti-PD-1, or anti-PD-L1 antibody, or comprises an antigen binding fragment of the anti-CTLA-4, anti-PD-1 or anti-PD-L1 antibody.

2. The method of claim 1, comprising:
administering the PEGylated soluble PH20 hyaluronidase wherein:
the hyaluronidase is a human hyaluronidase; and
at about 24 hours after administration of the PEGylated soluble PH20 hyaluronidase, administering the immune checkpoint inhibitor antibody or antigen binding fragment thereof.

3. The method of claim 1, wherein the PEGylated soluble PH20 hyaluronidase is administered at about 24 hours prior to administration of the immune checkpoint inhibitor antibody or antigen binding fragment thereof.

4. The method of claim 1, wherein the cancer comprises a solid tumor.

5. The method of claim 1, wherein the cancer is selected from among pancreatic cancer, breast cancer, prostate cancer, bladder cancer, gastric cancer, mesothelioma, non-small cell lung cancer (NSCLC), and colon cancer.

6. The method of claim 1, wherein the soluble hyaluronidase in the PEGylated soluble PH20 hyaluronidase is a human PH20.

7. The method of claim 1, wherein the PEGylated soluble PH20 hyaluronidase is a C-terminal truncated human PH20 selected from among:
 a) a contiguous sequence of amino acids in SEQ ID NO: 217 that contains amino acid residues 36-464 of SEQ ID NO: 217, and residues up to a C-terminal amino acid residue, whereby the polypeptide is C-terminally truncated so that it does not include the full-length of the polypeptide whose sequence is set forth as amino acids 1-509 or 36-509 of SEQ ID NO: 217; and
 b) a sequence of amino acids that has at least about 95%, 96%, 97%, 98%, or 99% sequence identity to a sequence of amino acids of a) that is soluble and retains hyaluronidase activity.

8. The method of claim 7, wherein the soluble hyaluronidase in the PEGylated soluble PH20 hyaluronidase comprises the sequence of amino acids set forth in any of SEQ ID NOS: 123-158, or a sequence of amino acids that exhibits at least 95% sequence identity to a sequence of amino acids set forth in any of SEQ ID NOS: 123-158 and retains hyaluronidase activity.

9. The method of claim 8, wherein:
the PEG is methoxypolyethylene glycol (mPEG).

10. The method of claim 1, wherein the immune checkpoint inhibitor antibody or antigen binding fragment thereof is an antibody that is a monoclonal antibody or antigen binding fragment thereof.

11. The method of claim 1, wherein the immune checkpoint inhibitor antibody or antigen binding fragment thereof is an antibody or antigen binding fragment thereof that is an anti-CTLA-4 antibody or antigen binding fragment thereof.

12. The method of claim 11, wherein the anti-CTLA-4 antibody or antigen-binding fragment thereof is selected from among:
 a) Ipilimumab, a derivative thereof, or an antigen-binding fragment thereof, comprising:
 a heavy chain variable domain consisting of the sequence of amino acids set forth in SEQ ID NO: 22 and a light chain variable domain consisting of the sequence of amino acids set forth in SEQ ID NO: 24; or
 a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 22 and a variable light chain consisting of a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 24; and
 b) Tremelimumab, a derivative thereof, or an antigen-binding fragment thereof, comprising:
 a heavy chain variable domain consisting of the sequence of amino acids set forth in SEQ ID NO: 34 and a light chain variable domain consisting of the sequence of amino acids set forth in SEQ ID NO: 36; or
 a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 34 and a variable light chain consisting of a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 36.

13. The method of claim 1, wherein the immune checkpoint inhibitor antibody or antigen binding fragment is an anti-PD-1 antibody or antigen binding fragment thereof.

14. The method of claim 1, wherein the immune checkpoint inhibitor antibody or antigen binding fragment is an anti-PD-1 antibody or antigen-binding fragment thereof, selected from among:
a) Nivolumab, or an antigen-binding fragment thereof, comprising:
a heavy chain variable domain consisting of the sequence of amino acids set forth in SEQ ID NO: 54 and a light chain variable domain consisting of the sequence of amino acids set forth in SEQ ID NO: 56; or
a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 54 and a variable light chain consisting of a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 56;
b) MK-3475, or an antigen-binding fragment thereof, comprising:
a heavy chain variable domain consisting of the sequence of amino acids set forth in SEQ ID NO: 68 and a light chain variable domain consisting of the sequence of amino acids set forth in SEQ ID NO: 70; or
a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 68 and a variable light chain consisting of a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 70; and
c) Pidilizumab, or an antigen-binding fragment thereof, comprising:
a heavy chain variable domain consisting of the sequence of amino acids set forth in SEQ ID NO: 82 and a light chain variable domain consisting of the sequence of amino acids set forth in SEQ ID NO: 84; or
a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 82 and a variable light chain consisting of a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 84.

15. The method of claim 1, wherein the immune checkpoint inhibitor antibody or antigen binding fragment thereof is an anti-PD-L1 antibody or antigen-binding fragment thereof.

16. The method of claim 15, wherein the anti-PD-L1 antibody or antigen-binding fragment thereof is selected from among:
a) BMS-936559, or an antigen-binding fragment thereof, comprising:
a heavy chain variable domain consisting of the sequence of amino acids set forth in SEQ ID NO: 92 and a light chain variable domain consisting of the sequence of amino acids set forth in SEQ ID NO: 94; or
a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 92 and a variable light chain consisting of a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 94;
b) MEDI4736, or an antigen-binding fragment thereof, comprising:
a heavy chain variable domain consisting of the sequence of amino acids set forth in SEQ ID NO: 102 and a light chain variable domain consisting of the sequence of amino acids set forth in SEQ ID NO: 104; or
a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 102 and a variable light chain consisting of a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 104; and
c) MPDL3280A, or an antigen-binding fragment thereof, comprising:
a heavy chain variable domain consisting of the sequence of amino acids set forth in SEQ ID NO: 114 and a light chain variable domain consisting of the sequence of amino acids set forth in SEQ ID NO: 115; or
a variable heavy chain consisting of a sequence of amino acids that has a sequence identity of at least 85%, 86%, 87%, 88%, 89%, 90%, 91%, 92%, 93%, 94%, 95%, 96%, 97%, 98%, or 99% to the heavy chain set forth in SEQ ID NO: 114 and a variable light chain consisting of a sequence of amino acids that has a sequence identity of at least 85%, 86%, 87%, 88%, 89%, 90%, 91%, 92%, 93%, 94%, 95%, 96%, 97%, 98%, 99% to the light chain set forth in SEQ ID NO: 115.

17. The method of claim 13, wherein the PEGylated soluble PH20 hyaluronidase is administered at about 24 hours before the immune checkpoint inhibitor antibody or an antigen binding fragment thereof.

18. The method of claim 15, wherein the PEGylated soluble PH20 hyaluronidase is administered at about 24 hours before the immune checkpoint inhibitor antibody or an antigen binding fragment thereof.

19. The method of claim 4, wherein:
the solid tumor comprises a moderate to high hyaluronan (HA) solid tumor;
the amount of HA is high if the amount is at least or at least about 2.5-fold higher than the amount or level of HA in a corresponding normal, control or healthy tissue; and
the amount of HA is moderate if the amount is at about 1.3-fold to 2-fold or higher than the amount or level of HA in a corresponding normal, control or healthy tissue.

20. The method of claim 1, wherein the soluble hyaluronidase in the PEGylated soluble PH20 hyaluronidase is a human PH20 that lacks a C-terminal glycosylphosphatidylinositol (GPI) attachment site or a portion of the GPI attachment site, whereby the PH20 is soluble.

21. The method of claim 1, wherein the PEGylated soluble PH20 hyaluronidase comprises a sequence of amino acids set forth in any of SEQ ID NOS: 123-158, or a sequence of amino acids that exhibits at least 98% sequence identity to a sequence of amino acids set forth in any of SEQ ID NOS: 123-158 and retains hyaluronidase activity.

22. The method of claim 1, wherein the primary sequence of the soluble PH20 hyaluronidase in the PEGylated soluble PH20 hyaluronidase consists of sequence of amino acids set forth in SEQ ID NO:123.

\* \* \* \* \*